United States Patent
Patel et al.

(10) Patent No.: US 11,865,134 B2
(45) Date of Patent: Jan. 9, 2024

(54) TREATMENT OF INFLAMMATION WITH GLUCOCORTICOIDS AND ANGIOPOIETIN-LIKE 7 (ANGPTL7) INHIBITORS

(71) Applicant: Regeneron Pharmaceuticals, Inc., Tarrytown, NY (US)

(72) Inventors: Gaurang Patel, Tarrytown, NY (US); Ying Hu, Tarrytown, NY (US); Kavita Praveen, Tarrytown, NY (US); Giovanni Coppola, Tarrytown, NY (US); Goncalo Abecasis, Tarrytown, NY (US); Aris Baras, Tarrytown, NY (US); Carmelo Romano, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

(21) Appl. No.: 17/678,792

(22) Filed: Feb. 23, 2022

(65) Prior Publication Data
US 2022/0370489 A1 Nov. 24, 2022

Related U.S. Application Data

(60) Provisional application No. 63/287,187, filed on Dec. 8, 2021, provisional application No. 63/251,175, filed on Oct. 1, 2021, provisional application No. 63/171,218, filed on Apr. 6, 2021, provisional application No. 63/154,576, filed on Feb. 26, 2021.

(51) Int. Cl.
| | |
|---|---|
| C07H 21/02 | (2006.01) |
| C07H 21/04 | (2006.01) |
| A61K 31/713 | (2006.01) |
| A61P 27/06 | (2006.01) |
| A61K 45/06 | (2006.01) |
| C12Q 1/6883 | (2018.01) |

(52) U.S. Cl.
CPC ............ *A61K 31/713* (2013.01); *A61K 45/06* (2013.01); *A61P 27/06* (2018.01); *C12Q 1/6883* (2013.01); *C12Q 2600/156* (2013.01)

(58) Field of Classification Search
CPC .......................... C12N 15/113; C12N 2310/14
See application file for complete search history.

(56) References Cited

U.S. PATENT DOCUMENTS

| | | | |
|---|---|---|---|
| 8,637,640 B2 | 1/2014 | Siekmann et al. |
| 8,642,737 B2 | 2/2014 | Siekmann et al. |
| 8,785,139 B2 | 7/2014 | Weber et al. |
| 8,809,501 B2 | 8/2014 | Siekmann et al. |
| 8,945,897 B2 | 2/2015 | Siekmann et al. |
| 8,951,982 B2 | 2/2015 | Jimenez et al. |
| 9,205,064 B2 | 12/2015 | Narain et al. |
| 9,238,837 B2 | 1/2016 | Schmidt-Ott et al. |
| 9,364,542 B2 | 6/2016 | Chang |
| 9,447,431 B2 | 9/2016 | Thess et al. |
| 9,492,555 B2 | 11/2016 | Haider et al. |
| 9,551,034 B2 | 1/2017 | Cowens et al. |
| 9,731,024 B2 | 8/2017 | Siekmann et al. |
| 9,795,683 B2 | 10/2017 | Jain et al. |
| 9,896,731 B2 | 2/2018 | Narain et al. |
| 10,111,968 B2 | 10/2018 | Thess et al. |
| 10,350,301 B2 | 7/2019 | Siekmann et al. |
| 10,351,915 B2 | 7/2019 | Narain et al. |
| 10,370,643 B2 | 8/2019 | Bernstein et al. |
| 10,414,793 B2 | 9/2019 | Haider et al. |
| 10,519,504 B2 | 12/2019 | Narain et al. |
| 2010/0028875 A1 | 2/2010 | Rhyu et al. |
| 2011/0020312 A1 | 1/2011 | Narain et al. |
| 2011/0027247 A1 | 2/2011 | Narain et al. |
| 2011/0123986 A1 | 5/2011 | Narain et al. |
| 2012/0010230 A1 | 1/2012 | MacDougall et al. |
| 2013/0022983 A1 | 1/2013 | Grifantini et al. |
| 2013/0310546 A1 | 11/2013 | Ray et al. |
| 2014/0107320 A1 | 4/2014 | Haider et al. |
| 2014/0187607 A1 | 7/2014 | Russell et al. |
| 2015/0023940 A1 | 1/2015 | Narain et al. |
| 2015/0025012 A1 | 1/2015 | MacDougall et al. |
| 2015/0174203 A1 | 6/2015 | Chen et al. |
| 2015/0299798 A1 | 10/2015 | de Reynies et al. |
| 2016/0120994 A1 | 5/2016 | Siekmann et al. |
| 2016/0145693 A1 | 5/2016 | Narain et al. |
| 2016/0271253 A1 | 9/2016 | Chang |
| 2017/0121780 A1 | 5/2017 | Cowens et al. |

(Continued)

FOREIGN PATENT DOCUMENTS

| | | |
|---|---|---|
| WO | 2012016131 | 2/2012 |
| WO | 2013147330 | 10/2013 |

(Continued)

OTHER PUBLICATIONS

Elbashir et al. (The EMBO Journal, vol. 20, No. 23, pp. 6877-6888, 2001).*
Non-Final Office Action dated Oct. 6, 2022 in related U.S. Appl. No. 17/031,523.
International Search Report and Written Opinion dated Jul. 14, 2022 for International Patent Application No. PCT/US2022/017533.
Karaki et al., "Antisense Oligonucleolides, A Novel Developing Targeting Therapy", Antisense Therapy, 2019, pp. 1-18.
Harborth et al., "Identification of essential genes in cultured mammalian cells using small interfering RNAs", J Cell Sci, 2001, 114(Pt 24), pp. 4557-4565.
Holen T et al., "Positional effects of short interfering RNAs targeting the human coagulation trigger Tissue Factor", Nucleic Acids Res, 2002, 30(8), pp. 1757-1766.

(Continued)

*Primary Examiner* — Amy H Bowman
(74) *Attorney, Agent, or Firm* — Armstrong Teasdale LLP

(57) ABSTRACT

The present disclosure provides methods of treating subjects having inflammation with an Angiopoietin-Like 7 (ANGPTL7) inhibitor and a glucocorticoid, methods of decreasing glucocorticoid-induced ophthalmic conditions in subjects, and methods of identifying subjects having an increased risk of developing glucocorticoid-induced ophthalmic conditions.

3 Claims, 4 Drawing Sheets
Specification includes a Sequence Listing.

(56) References Cited

U.S. PATENT DOCUMENTS

| | | |
|---|---|---|
| 2017/0137879 A1 | 5/2017 | Narain et al. |
| 2017/0368193 A1 | 12/2017 | Siekmann et al. |
| 2018/0177894 A1 | 6/2018 | Thess et al. |
| 2018/0185517 A1 | 7/2018 | Thess et al. |
| 2018/0200380 A1 | 7/2018 | Jain et al. |
| 2018/0237771 A1 | 8/2018 | Kim et al. |
| 2018/0334721 A1 | 11/2018 | Narain et al. |
| 2018/0340153 A1 | 11/2018 | Bean et al. |
| 2018/0340154 A1 | 11/2018 | Bean et al. |
| 2019/0010554 A1 | 1/2019 | Narain et al. |
| 2019/0091335 A1 | 3/2019 | Chang |
| 2019/0177391 A1 | 6/2019 | Chen et al. |
| 2019/0264173 A1 | 8/2019 | Studer et al. |
| 2019/0203186 A1 | 9/2019 | Bean et al. |
| 2019/0314516 A1 | 10/2019 | Siekmann et al. |
| 2019/0322989 A1 | 10/2019 | Bean et al. |
| 2019/0330593 A1 | 10/2019 | Bernstein et al. |
| 2019/0331666 A1 | 10/2019 | Studer et al. |
| 2020/0016202 A1 | 1/2020 | Kuchroo et al. |
| 2020/0017543 A1 | 1/2020 | Haider et al. |
| 2020/0399640 A1 | 12/2020 | Gottesman et al. |

FOREIGN PATENT DOCUMENTS

| | | |
|---|---|---|
| WO | 2013173543 | 11/2013 |
| WO | 2013173557 | 11/2013 |
| WO | 2014167529 | 10/2014 |
| WO | 2015132303 | 9/2015 |
| WO | 2018174861 | 9/2018 |
| WO | 2018175630 | 9/2018 |
| WO | 2018218299 | 12/2018 |
| WO | 2019140380 | 7/2019 |
| WO | 2019144052 | 7/2019 |
| WO | 2019197844 | 10/2019 |
| WO | 2020154268 | 7/2020 |
| WO | 2020242896 | 12/2020 |
| WO | 2022072356 | 4/2022 |

OTHER PUBLICATIONS

Reynolds et al., "Rational siRNA design for RNA interference", Nat Biotechnol, 2004, 22(3), pp. 326-330.

Ronchetti et al., "Defining the role of glucocorticoids in inflammation", Clinical Science, 2018, 132(14), pp. 1529-1543.

Baudouin et al., "Inflammation in Glaucoma: From the back to the front of the eye and beyond", Progress in Retinal and Eye Research, 2020, 83, pp. 1-26.

Qian et al., "Angiopoietin-Like Protein 7 Promotes an Inflammatory Phenotype in RAW264.7 Macrophages Through the P38 MAPK Signaling Pathway", Inflammation, 2016, 39(3), pp. 974-985.

Roberti et al., "Steroid-induced glaucoma: Epidemiology, pathophysiology, and clinical management", Survey of Ophthalmology, 2020, 65(4), pp. 458-473.

Fukuda et al., "Expression Profiling of Genes in Rheumatoid Fibroblast-like Synoviocytes Regulated by Fas Ligand Using cDNA Microarray Analysis", Arthritis & Rheumatology, 2019, 71(suppl-10), pp. 1.

Notice of Allowance dated Jul. 25, 2022 in related U.S. Appl. No. 17/318,023.

Non-final Office Action dated Aug. 25, 2022 in related U.S. Appl. No. 16/748,006.

Tanigawa et al., "Rare protein-altering variants in ANGPTL7 lower intraocular pressure and protect against glaucoma", PLoS Genetics, 2020, 16(5), e1008682, pp. 1-20.

Final Office Action dated Apr. 6, 2022 in related U.S. Appl. No. 17/318,023.

Toyono et al., "Angiopoietin-Like 7 Is an Anti-Angiogenic Protein Required to Prevent Vascularization of the Cornea", PLoS One, 2015, 10(1), pp. 1-13.

Weinreb et al., "Acute Effects of Dexamethasone on Intraocular Pressure in Glaucoma", Investigative Ophthalmology and Visual Science, 1985, 26, pp. 170-175.

Non-Final Office Action dated Dec. 28, 2021 in related U.S. Appl. No. 17/318,023.

Borras, "Gene therapy strategies in glaucoma and application for steroid-induced hypertension", Saudi Journal of Opthalmology, 2011, 25(4), pp. 353-362.

Buie et al., "Angiopoietin-like 7 (ANGPTL7) Modulates DEX Induction and Fibronectin (FN1) Fibrils Formation in the Human Trabecular Meshwork (HTM)—ARVO Annual Meeting Abstract", Investigative Ophthalmology & Visual Science, 2011, 52(14), pp. 4622.

Charlson et al., "The primary open-angle african american glaucoma genetics study: baseline demographics", Ophthalmology, 2015, 122, pp. 711-720.

Comes et al., "Evidence for a role of angiopoietin-like 7 (ANGPTL7) in extracellular matrix formation of the human trabecular meshwork: implications for glaucoma: ANGPTL7 in the human trabecular meshwork", Genes to Cells, 2010, 16(2), pp. 243-259.

Dewey et al., "Distribution and clinical impact of functional variants in 50,726 whole-exome sequences from the DiscovEHR Study", Science, 2016, 354(6319), pp. 1-13.

Deboever et al., "Bayesian model comparison for rare variant association studies for multiple phenotypes", BioRxiv, 2018, https://www.biorxiv.org/content/10.1101/257162v5.full.pdf.

Doench et al., "Optimized sgRNA design to maximize activity and minimize off-target effects of CRISPR-Cas9", Nature Biotechnology, 2016, 34(2), pp. 184-191.

Jaru-Ampornpan et al., "Screening Angiopoietin-Like 7 in Primary Congenital Glaucoma Patients—ARVO Annual Meeting Abstract", Investigative Ophthalmology & Visual Science, 2010, 51(13), pp. 2167.

Kuchtey et al., "Angiopoietin-like 7 secretion is induced by glaucoma stimuli and its concentration is elevated in glaucomatous aqueous humor", Investigative Ophthalmology & Visual Science, 2008, 49(8), pp. 3438-3448.

Rozsa et al., "Gene expression profile of human trabecular meshwork cells in response to long-term dexamethasone exposure", Molecular Vision, 2006, 12, pp. 125-141.

Tanigawa et al., "Rare protein-altering variants in ANGPTL7 lower intraocular pressure and protect against glaucoma", BioRxiv, 2019, https://www.biorxiv.org/content/10.1101/677443v2.full.pdf.

Usui et al., "To Protect Corneal Transparency against Diseases", Journal of Japanese Ophthalmological Society, 2016, 120, pp. 246-263.

Van Hout et al., "Whole exome sequencing and characterization of coding variation in 49,960 individuals in the UK Biobank", BioRxiv, 2019, doi: https://doi.org/10.1101/572347.

Willoughby et al., "Mutational Screening Of The Angiopoietin-like 7 Gene In High-tension Primary Open Angle Glaucoma", Investigative Ophthalmology & Visual Science, 2012, 53, pp. 4504.

Xiao et al., "Loss of Angiopoietin-like 7 diminishes the regeneration capacity of hematopoietic stem and progenitor cells", Journal of Hematology & Oncology, 2015, 8(1), pp. 7.

International Search Report and Written Opinion dated Aug. 11, 2020 for International Patent Application No. PCT/US2020/014373.

Notice of Allowance dated May 10, 2023 in related U.S. Appl. No. 16/748,006.

Advisory Action dated May 30, 2023 in related U.S. Appl. No. 17/031,523.

Ozcan et al., "Preclinical and clinical development of siRNA-based therapeutics", Adv Drug Deliv, 2015, 87, pp. 108-119.

Chan et al., "The complexity of antisense transcription revealed by the study of developing male germ cells", Genomics, 2006, 87, pp. 681-692.

Final Office Action dated Mar. 9, 2023 in related U.S. Appl. No. 16/748,006.

Final Office Action dated Mar. 17, 2023 in related U.S. Appl. No. 17/031,523.

Notice of Allowance dated Aug. 1, 2023 in related U.S. Appl. No. 17/031,523.

\* cited by examiner

TREATMENT OF INFLAMMATION WITH GLUCOCORTICOIDS AND ANGIOPOIETIN-LIKE 7 (ANGPTL7) INHIBITORS

REFERENCE TO SEQUENCE LISTING

This application includes a Sequence Listing submitted electronically as a text file named 18923806701SEQ, created on Feb. 22, 2022, with a size of 111 kilobytes. The Sequence Listing is incorporated herein by reference.

FIELD

The present disclosure relates generally to the treatment of subjects having inflammation with an Angiopoietin-Like 7 (ANGPTL7) inhibitor and a glucocorticoid, methods of decreasing glucocorticoid-induced ophthalmic conditions in subjects, and methods of identifying subjects having an increased risk of developing glucocorticoid-induced ophthalmic conditions.

BACKGROUND

Glucocorticoids (GCs) are one of the most commonly prescribed medications worldwide for the treatment of a plethora of diseases and conditions. Because of their broad-spectrum anti-inflammatory and immunosuppressive properties, the worldwide market for GC use is estimated to be greater than $10 billion per year. Approximately 1.2% of the United States population and 0.85% of the United Kingdom population are prescribed therapeutic GCs every year. GCs also remain the mainstay of treatment for a variety of ocular inflammatory diseases involving almost all tissues of the eye, such as eyelids, conjunctiva, cornea, sclera, uvea, retina, and optic nerve. The routes of GC administration in treatment of these disorders can be topical ocular, oral, systemic, intravitreal injection, implants, and periocular injections (including, for example, subconjunctival, sub-tenon, retrobulbar, and peribulbar). Prolonged GC therapy, however, can be associated with serious, unwanted GC-induced ophthalmic conditions, including development of posterior subcapsular cataracts, the development of GC-induced ocular hypertension (GC-OHT), and iatrogenic open-angle glaucoma. About 40% of individuals exposed to long-term steroids develop steroid-induced ocular hypertension and this risk can increase to about 90% in individuals who already have glaucoma. Thus, decreasing or preventing GC-induced ophthalmic conditions is desirable.

SUMMARY

The present disclosure provides methods of treating a subject undergoing treatment with a steroid, the methods comprising administering an ANGPTL7 inhibitor to the subject.

The present disclosure provides methods of treating a subject having inflammation, the methods comprising administering an ANGPTL7 inhibitor and a glucocorticoid to the subject.

The present disclosure also provides methods of treating a subject having rheumatoid arthritis, the methods comprising administering an ANGPTL7 inhibitor and a glucocorticoid to the subject.

The present disclosure also provides methods of treating a subject having Grave's disease, the methods comprising administering an ANGPTL7 inhibitor and a glucocorticoid to the subject.

The present disclosure also provides methods of treating a subject having ophthalmic inflammation, the methods comprising administering an ANGPTL7 inhibitor and a glucocorticoid to the subject.

The present disclosure provides methods of decreasing a steroid-induced ophthalmic condition in a subject treated with a steroid, the methods comprising administering an ANGPTL7 inhibitor to the subject.

The present disclosure also provides methods of decreasing a glucocorticoid-induced ophthalmic condition in a subject treated with a glucocorticoid, the methods comprising administering an ANGPTL7 inhibitor to the subject.

The present disclosure provides methods of treating a subject having inflammation and undergoing steroid treatment, the methods comprising administering an ANGPTL7 inhibitor to the subject.

The present disclosure also provides methods of treating a subject having inflammation and undergoing glucocorticoid treatment, the methods comprising administering an ANGPTL7 inhibitor to the subject.

The present disclosure also provides methods of treating a subject having rheumatoid arthritis and undergoing glucocorticoid treatment, the methods comprising administering an ANGPTL7 inhibitor to the subject.

The present disclosure also provides methods of treating a subject having Grave's disease and undergoing glucocorticoid treatment, the methods comprising administering an ANGPTL7 inhibitor to the subject.

The present disclosure also provides methods of treating a subject having ophthalmic inflammation and undergoing glucocorticoid treatment, the methods comprising administering an ANGPTL7 inhibitor to the subject.

The present disclosure also provides methods of treating a subject undergoing glucocorticoid treatment, wherein the subject is suffering from inflammation, the methods comprising: determining whether the subject has an ANGPTL7 predicted loss-of-function variant nucleic acid molecule encoding an ANGPTL7 polypeptide by: obtaining or having obtained a biological sample from the subject; and performing or having performed a sequence analysis on the biological sample to determine if the subject has a genotype comprising the ANGPTL7 predicted loss-of-function variant nucleic acid molecule; and administering or continuing to administer to a subject that is ANGPTL7 reference the glucocorticoid in a standard dosage amount, and administering an ANGPTL7 inhibitor to the subject; or administering or continuing to administer to a subject that is heterozygous for the ANGPTL7 predicted loss-of-function variant the glucocorticoid in an amount that is the same as or higher than a standard dosage amount, and administering an ANGPTL7 inhibitor to the subject; or administering or continuing to administer to a subject that is homozygous for the ANGPTL7 predicted loss-of-function variant the glucocorticoid in an amount that is the same as or higher than a standard dosage amount; wherein the presence of a genotype having the ANGPTL7 predicted loss-of-function variant nucleic acid molecule encoding the ANGPTL7 polypeptide indicates the subject has a decreased risk of developing a glucocorticoid-induced ophthalmic condition.

The present disclosure also provides methods of identifying a subject undergoing glucocorticoid treatment having an increased risk for developing a glucocorticoid-induced ophthalmic condition, the method comprising: determining or having determined the presence or absence of an ANGPTL7 predicted loss-of-function variant nucleic acid molecule encoding an ANGPTL7 polypeptide in a biological sample obtained from the subject; wherein: when the subject is ANGPTL7 reference, then the subject has an increased risk for developing the glucocorticoid-induced ophthalmic condition; and when the subject is heterozygous or homozygous for an ANGPTL7 predicted loss-of-function variant, then the subject does not have an increased risk for developing the glucocorticoid-induced ophthalmic condition.

The present disclosure also provides combinations of a glucocorticoid and an ANGPTL7 inhibitor for use in the treatment of inflammation in a subject identified as having: a genomic nucleic acid molecule having a nucleotide sequence encoding an ANGPTL7 polypeptide, wherein the nucleotide sequence comprises: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof; an mRNA molecule having a nucleotide sequence encoding an ANGPTL7 polypeptide, wherein the nucleotide sequence comprises: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof; or a cDNA molecule having a nucleotide sequence encoding an ANGPTL7 polypeptide, wherein the nucleotide sequence comprises: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof.

The present disclosure also provides combinations of a glucocorticoid and an ANGPTL7 inhibitor for use in the preparation of a medicament for treating inflammation in a subject identified as having: a genomic nucleic acid molecule having a nucleotide sequence encoding an ANGPTL7 polypeptide, wherein the nucleotide sequence comprises: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof; an mRNA molecule having a nucleotide sequence encoding an ANGPTL7 polypeptide, wherein the nucleotide sequence comprises: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof; or a cDNA molecule having a nucleotide sequence encoding an ANGPTL7 polypeptide, wherein the nucleotide sequence comprises: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof.

The present disclosure also provides ANGPTL7 inhibitors for use in decreasing or preventing a glucocorticoid-induced ophthalmic condition in a subject undergoing glucocorticoid treatment, wherein the subject is identified as being: a) ANGPTL7 reference for an ANGPTL7 genomic nucleic acid molecule, an ANGPTL7 mRNA molecule, or an ANGPTL7 cDNA molecule; or b) heterozygous for: i) a genomic nucleic acid molecule having a nucleotide sequence encoding an ANGPTL7 polypeptide, wherein the nucleotide sequence comprises: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof; ii) an mRNA molecule having a nucleotide sequence encoding an ANGPTL7 polypeptide, wherein the nucleotide sequence comprises: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof; or iii) a cDNA molecule having a nucleotide sequence encoding an ANGPTL7 polypeptide, wherein the nucleotide sequence comprises: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof.

The present disclosure also provides ANGPTL7 inhibitors for use in the preparation of a medicament for decreasing or preventing a glucocorticoid-induced ophthalmic condition in a subject undergoing glucocorticoid treatment, wherein the subject is identified as being: a) ANGPTL7 reference for an ANGPTL7 genomic nucleic acid molecule, an ANGPTL7 mRNA molecule, or an ANGPTL7 cDNA molecule; or b) heterozygous for: i) a genomic nucleic acid molecule having a nucleotide sequence encoding an ANGPTL7 polypeptide, wherein the nucleotide sequence comprises: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof; ii) an mRNA molecule having a nucleotide sequence encoding an ANGPTL7 polypeptide, wherein the nucleotide sequence comprises: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof; or iii) a cDNA molecule having a nucleotide sequence encoding an ANGPTL7 polypeptide, wherein the nucleotide sequence comprises: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof.

BRIEF DESCRIPTION OF THE DRAWINGS

The accompanying figures, which are incorporated in and constitute a part of this specification, illustrate several features of the present disclosure.

DESCRIPTION

Figure 1:
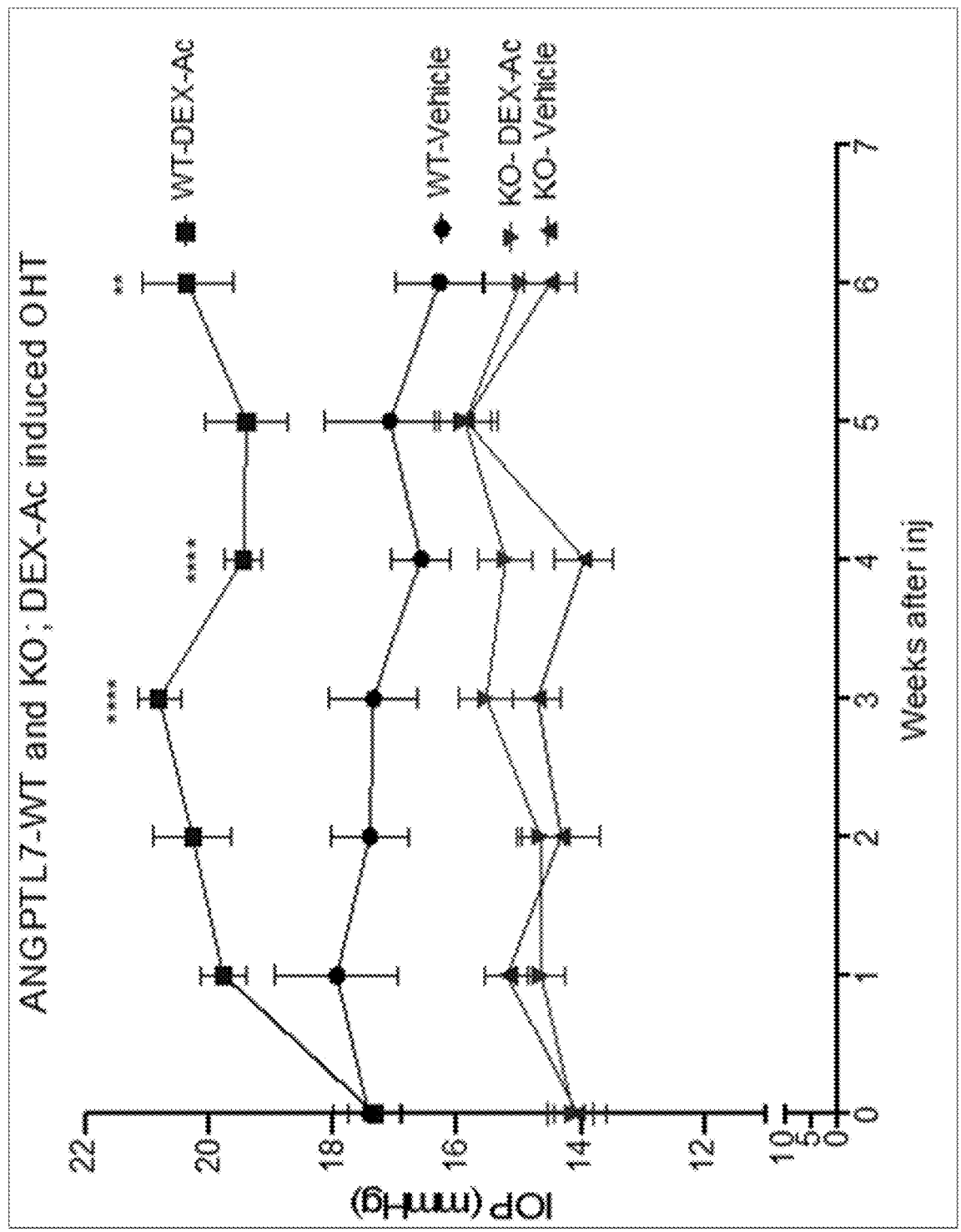
FIG. 1 shows inhibition of dexamethasone-21-acetate (DEX-Ac)-induced ocular hypertension in Angptl7 knockout (KO) mice.

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the term "isolated", in regard to a nucleic acid molecule or a polypeptide, means that the nucleic acid molecule or polypeptide is in a condition other than its native environment, such as apart from blood and/or animal tissue. In some embodiments, an isolated nucleic acid molecule or polypeptide is substantially free of other nucleic acid molecules or other polypeptides, particularly other nucleic acid molecules or polypeptides of animal origin. In some embodiments, the nucleic acid molecule or polypeptide can be in a highly purified form, i.e., greater than 95% pure or greater than 99% pure. When used in this context, the term "isolated" does not exclude the presence of the same nucleic acid molecule or polypeptide in alternative physical forms, such as dimers or alternatively phosphorylated or derivatized forms.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates (such as, for example, apes and monkeys). In some embodiments, the subject is a human. In some embodiments, the subject is a patient under the care of a physician.

The present disclosure demonstrates that inhibiting ANGPTL7 activity, such as in Angptl7 KO mice, surprisingly and unexpectedly suppresses the GC-mediated increase in ocular hypertension. Thus, it is believed that treatment of subjects undergoing glucocorticoid treatment of, for example, inflammation, with ANGPTL7 inhibitors can decrease or prevent undesirable glucocorticoid-induced ophthalmic conditions. It is believed that no ANGPTL7 inhibitors have any known association with decreasing or preventing undesirable glucocorticoid-induced ophthalmic conditions. Therefore, subjects that are ANGPTL7 reference that have an increased risk of developing glucocorticoid-induced ophthalmic conditions may be treated such that the glucocorticoid-induced ophthalmic conditions are prevented, the symptoms thereof are reduced, and/or development of symptoms is repressed. Accordingly, the present disclosure provides methods of leveraging the identification of ANGPTL7 reference subjects undergoing glucocorticoid treatment to identify or stratify risk in such subjects of developing glucocorticoid-induced ophthalmic conditions such that subjects at risk or subjects with active glucocorticoid-induced ophthalmic conditions may be treated accordingly.

For purposes of the present disclosure, any particular subject can be categorized as having one of three ANGPTL7 genotypes: i) ANGPTL7 reference; ii) heterozygous for an ANGPTL7 predicted loss-of-function variant; or iii) homozygous for an ANGPTL7 predicted loss-of-function variant. A subject is ANGPTL7 reference when the subject does not have a copy of an ANGPTL7 predicted loss-of-function variant nucleic acid molecule. A subject is heterozygous for an ANGPTL7 predicted loss-of-function variant when the subject has a single copy of an ANGPTL7 predicted loss-of-function variant nucleic acid molecule. As used herein, an ANGPTL7 predicted loss-of-function variant nucleic acid molecule is any ANGPTL7 nucleic acid molecule (such as, a genomic nucleic acid molecule, an mRNA molecule, or a cDNA molecule) encoding an ANGPTL7 polypeptide having a partial loss-of-function, a complete loss-of-function, a predicted partial loss-of-function, or a predicted complete loss-of-function. A subject who has an ANGPTL7 polypeptide having a partial loss-of-function (or predicted partial loss-of-function) is hypomorphic for ANGPTL7. The ANGPTL7 predicted loss-of-function variant nucleic acid molecule can be any nucleic acid molecule encoding an ANGPTL7 Arg177STOP, Gln175His, Phe161Ile, Trp188STOP, Lys192Gln, Arg340His, Arg220His, Asn302Lys, or Arg220Cys. In some embodiments, the ANGPTL7 predicted loss-of-function variant nucleic acid molecule encodes an ANGPTL7 Arg177STOP, Gln175His, Phe161Ile, Trp188STOP, or Lys192Gln. A subject is homozygous for an ANGPTL7 predicted loss-of-function variant when the subject has two copies of an ANGPTL7 predicted loss-of-function variant nucleic acid molecule.

For subjects that are genotyped or determined to be ANGPTL7 reference, such subjects have an increased risk of developing glucocorticoid-induced ophthalmic conditions such as, for example, ocular hypertension, increased intraocular pressure (IOP), pre-glaucoma, glaucoma, decreased corneal hysteresis, and posterior subcapsular cataracts, or any combination thereof. In some embodiments, the IOP is corneal-compensated intraocular pressure (IOPcc). In some embodiments, the IOP is Goldmann-correlated IOP (IOPg). For subjects that are genotyped or determined to be either ANGPTL7 reference or heterozygous for an ANGPTL7 predicted loss-of-function variant, such subjects can be treated with an ANGPTL7 inhibitor.

In any of the embodiments described herein, the glaucoma can be primary open-angle glaucoma, iatrogenic open-angle glaucoma, angle-closure glaucoma, normal-tension glaucoma, congenital glaucoma, neovascular glaucoma, steroid-induced glaucoma, or glaucoma related to ocular trauma.

In any of the embodiments described herein, the ANGPTL7 predicted loss-of-function variant nucleic acid molecule can be any ANGPTL7 nucleic acid molecule (such as, for example, genomic nucleic acid molecule, mRNA molecule, or cDNA molecule) encoding an ANGPTL7 polypeptide having a partial loss-of-function, a complete loss-of-function, a predicted partial loss-of-function, or a predicted complete loss-of-function. For example, the ANGPTL7 predicted loss-of-function variant nucleic acid molecule can be any nucleic acid molecule encoding ANGPTL7 Arg177STOP, Gln175His, Phe161Ile, Trp188STOP, Lys192Gln, Arg340His, Arg220His, Asn302Lys, or Arg220Cys. In some embodiments, the ANGPTL7 predicted loss-of-function variant nucleic acid molecule encodes ANGPTL7 Arg177STOP, Gln175His, Phe161Ile, Trp188STOP, or Lys192Gln.

In any of the embodiments described herein, the ANGPTL7 predicted loss-of-function polypeptide can be any ANGPTL7 polypeptide having a partial loss-of-function, a complete loss-of-function, a predicted partial loss-of-function, or a predicted complete loss-of-function. In any of the embodiments described herein, the ANGPTL7 predicted loss-of-function polypeptide can be any of the ANGPTL7 polypeptides described herein including, for example, ANGPTL7 Arg177STOP, Gln175His, Phe161Ile, Trp188STOP, Lys192Gln, Arg340His, Arg220His, Asn302Lys, or Arg220Cys. In some embodiments, the ANGPTL7 predicted loss-of-function polypeptide is ANGPTL7 Arg177STOP, Gln175His, Phe161Ile, Trp188STOP, or Lys192Gln.

In any of the embodiments described herein, the inflammation can be acute inflammation or chronic inflammation. In some embodiments, the acute inflammation is inflammation having a relatively short duration, lasting from about a few minutes to about one to two days. Acute inflammation can be characterized by increased blood flow, exudation of fluid and plasma proteins (edema), and emigration of leukocytes, predominantly neutrophils. In some embodiments, the chronic inflammation is inflammation having a longer duration, such as days to weeks or even longer, and is associated histologically with the presence of lymphocytes and macrophages and with proliferation of blood vessels and connective tissue. In any of the embodiments described herein, the inflammation is associated with rheumatoid arthritis, associated with Grave's disease, or is ophthalmic inflammation. In some embodiments, the inflammation is associated with rheumatoid arthritis. In some embodiments, the inflammation is associated with Grave's disease. In some embodiments, the inflammation is ophthalmic inflammation. In some embodiments, the ophthalmic inflammation is chosen from uveitis, juvenile idiopathic arthritis uveitis, scleritis, blepharitis, conjunctivitis, iritis, and episcleritis, or any combination thereof. In some embodiments, the ophthalmic inflammation is uveitis. In some embodiments, the ophthalmic inflammation is juvenile idiopathic arthritis uveitis. In some embodiments, the ophthalmic inflammation is scleritis. In some embodiments, the ophthalmic inflammation is blepharitis. In some embodiments, the ophthalmic inflammation is conjunctivitis. In some embodiments, the ophthalmic inflammation is iritis. In some embodiments, the ophthalmic inflammation is episcleritis.

In any of the embodiments described herein, the glucocorticoid-induced ophthalmic condition is chosen from ocular hypertension, increased intraocular pressure (IOP), pre-glaucoma, glaucoma, decreased corneal hysteresis, and posterior subcapsular cataracts, or any combination thereof. In some embodiments, the glucocorticoid-induced ophthalmic condition is ocular hypertension. In some embodiments, the glucocorticoid-induced ophthalmic condition is increased IOP. In some embodiments, the glucocorticoid-induced ophthalmic condition is pre-glaucoma. In some embodiments, the glucocorticoid-induced ophthalmic condition is glaucoma. In some embodiments, the glucocorticoid-induced ophthalmic condition is decreased corneal hysteresis. In some embodiments, the glucocorticoid-induced ophthalmic condition is posterior subcapsular cataracts.

The present disclosure provides methods of treating a subject undergoing treatment with a steroid, the methods comprising administering an ANGPTL7 inhibitor to the subject.

The present disclosure provides methods of treating a subject having inflammation, the methods comprising administering an ANGPTL7 inhibitor and a glucocorticoid to the subject.

The present disclosure provides methods of treating a subject having rheumatoid arthritis, the methods comprising administering an ANGPTL7 inhibitor and a glucocorticoid to the subject.

The present disclosure provides methods of treating a subject having Grave's disease, the methods comprising administering an ANGPTL7 inhibitor and a glucocorticoid to the subject.

The present disclosure provides methods of treating a subject having ophthalmic inflammation, the methods comprising administering an ANGPTL7) inhibitor and a glucocorticoid to the subject.

The present disclosure provides methods of decreasing a steroid-induced ophthalmic condition in a subject treated with a steroid, the methods comprising administering an ANGPTL7 inhibitor to the subject.

The present disclosure provides methods of decreasing a glucocorticoid-induced ophthalmic condition in a subject treated with a glucocorticoid, the methods comprising administering an ANGPTL7 inhibitor to the subject.

The present disclosure provides methods of treating a subject having inflammation and undergoing steroid treatment, the methods comprising administering an ANGPTL7 inhibitor to the subject.

The present disclosure provides methods of treating a subject having inflammation and undergoing glucocorticoid treatment, the methods comprising administering an ANGPTL7 inhibitor to the subject.

The present disclosure provides methods of treating a subject having rheumatoid arthritis and undergoing glucocorticoid treatment, the methods comprising administering an ANGPTL7 inhibitor to the subject.

The present disclosure provides methods of treating a subject having Grave's disease and undergoing glucocorticoid treatment, the methods comprising administering an ANGPTL7 inhibitor to the subject.

The present disclosure provides methods of treating a subject having ophthalmic inflammation and undergoing glucocorticoid treatment, the methods comprising administering an ANGPTL7 inhibitor to the subject.

In any of the methods described herein, the inflammation can be acute inflammation or chronic inflammation. In some embodiments, the inflammation is acute inflammation. In some embodiments, the inflammation is chronic inflammation. In some embodiments, the inflammation is associated with rheumatoid arthritis, associated with Grave's disease, or is ophthalmic inflammation. In some embodiments, the inflammation is associated with rheumatoid arthritis. In some embodiments, the inflammation is associated with Grave's disease. In some embodiments, the inflammation is ophthalmic inflammation. In some embodiments, the ophthalmic inflammation is chosen from uveitis, juvenile idiopathic arthritis uveitis, scleritis, blepharitis, conjunctivitis, iritis, episcleritis, diabetic macular edema, corneal injury inflammation, ocular surgery pain or inflammation, or any combination thereof. In some embodiments, the ophthalmic inflammation is uveitis. In some embodiments, the ophthalmic inflammation is juvenile idiopathic arthritis uveitis. In some embodiments, the ophthalmic inflammation is scleritis. In some embodiments, the ophthalmic inflammation is blepharitis. In some embodiments, the ophthalmic inflammation is conjunctivitis. In some embodiments, the ophthalmic inflammation is iritis. In some embodiments, the ophthalmic inflammation is episcleritis. In some embodiments, the ophthalmic inflammation is diabetic macular edema. In some embodiments, the ophthalmic inflammation is corneal injury inflammation. In some embodiments, the ophthalmic inflammation is associated with ocular surgery.

In any of the methods described herein, the subject can be undergoing treatment with a steroid or have undergone treatment with a steroid. In some embodiments, such subject can have any of the forms of inflammation described herein. Steroids are used after several ophthalmic procedures including, but not limited to, cataract extraction, YAG laser capsulotomy, descement stripping automated endothelial keratoplasty (DSAEK), lamellar keratoplasty, penetrating keratoplasty, laser in-situ keratomileusis (LASIK), photorefractive keratectomy (PRK), Pars Planar Vitrectomy (PPV), and intralesional injection. In some embodiments, the subject is undergoing or has undergone cataract extraction. In some embodiments, the subject is undergoing or has undergone YAG laser capsulotomy. In some embodiments, the subject is undergoing or has undergone DSAEK. In some embodiments, the subject is undergoing or has undergone lamellar keratoplasty. In some embodiments, the subject is undergoing or has undergone penetrating keratoplasty. In some embodiments, the subject is undergoing or has undergone LASIK. In some embodiments, the subject is undergoing or has undergone PRK. In some embodiments, the subject is undergoing or has undergone PPV. In some embodiments, the subject is undergoing or has undergone intralesional injection.

In any of the methods described herein, the glucocorticoid-induced ophthalmic condition is chosen from ocular hypertension, increased intraocular pressure (IOP), pre-glaucoma, glaucoma, decreased corneal hysteresis, and posterior subcapsular cataracts, or any combination thereof. In some embodiments, the glucocorticoid-induced ophthalmic condition is ocular hypertension. In some embodiments, the glucocorticoid-induced ophthalmic condition is increased IOP. In some embodiments, the glucocorticoid-induced ophthalmic condition is pre-glaucoma. In some embodiments, the glucocorticoid-induced ophthalmic condition is glaucoma. In some embodiments, the glucocorticoid-induced ophthalmic condition is decreased corneal hysteresis. In some embodiments, the glucocorticoid-induced ophthalmic condition is posterior subcapsular cataracts.

In any of the methods described herein, the glucocorticoid is chosen from prednisone, prednisolone, methylprednisolone, dexamethasone, betamethasone, triamcinolone, beclometasone, fludrocortisone acetate, deoxycorticosterone acetate (DOCA), aldosterone, budesonide, mometasone furoate, fluticasone propionate, hydrocortisone, cortisone acetate, and fluticasone furoate, difluprednate ophthalmic, fluorometholone, loteprednol etabonate, medrysone, rimexolone, fluocinolone acetonide, clobetasol, halobetasol, diflorasone, fluocinonide, flurandrenolide, Neo-Poly-Dex, tobramycin-dexamethasone, difluprednate, or any combination thereof. In some embodiments, the glucocorticoid is prednisone. In some embodiments, the glucocorticoid is prednisolone. In some embodiments, the glucocorticoid is methylprednisolone. In some embodiments, the glucocorticoid is dexamethasone. In some embodiments, the glucocorticoid is betamethasone. In some embodiments, the glucocorticoid is triamcinolone. In some embodiments, the glucocorticoid is beclomethasone. In some embodiments, the glucocorticoid is fludrocortisone acetate. In some embodiments, the glucocorticoid is DOCA. In some embodiments, the glucocorticoid is aldosterone. In some embodiments, the glucocorticoid is budesonide. In some embodiments, the glucocorticoid is mometasone furoate. In some embodiments, the glucocorticoid is fluticasone propionate. In some embodiments, the glucocorticoid is hydrocortisone. In some embodiments, the glucocorticoid is cortisone acetate. In some embodiments, the glucocorticoid is fluticasone furoate. In some embodiments, the glucocorticoid is difluprednate ophthalmic. In some embodiments, the glucocorticoid is fluorometholone. In some embodiments, the glucocorticoid is loteprednol etabonate. In some embodiments, the glucocorticoid is medrysone. In some embodiments, the glucocorticoid is rimexolone. In some embodiments, the glucocorticoid is fluocinolone acetonide. In some embodiments, the glucocorticoid is clobetasol. In some embodiments, the glucocorticoid is halobetasol. In some embodiments, the glucocorticoid is diflorasone. In some embodiments, the glucocorticoid is fluocinonide. In some embodiments, the glucocorticoid is flurandrenolide. In some embodiments, the glucocorticoid is Neo-Poly-Dex. In some embodiments, the glucocorticoid is tobramycin-dexamethasone. In some embodiments, the glucocorticoid is difluprednate.

In any of the methods described herein, the glucocorticoid treatment is treatment with prednisone, prednisolone, methylprednisolone, dexamethasone, betamethasone, triamcinolone, beclometasone, fludrocortisone acetate, DOCA, aldosterone, budesonide, mometasone furoate, fluticasone propionate, hydrocortisone, cortisone acetate, or fluticasone furoate, difluprednate ophthalmic, fluorometholone, loteprednol etabonate, medrysone, rimexolone, fluocinolone acetonide, clobetasol, halobetasol, diflorasone, fluocinonide, flurandrenolide, Neo-Poly-Dex, tobramycin-dexamethasone, difluprednate, or any combination thereof. In some embodiments, the glucocorticoid treatment is treatment with prednisone. In some embodiments, the glucocorticoid treatment is treatment with prednisolone. In some embodiments, the glucocorticoid treatment is treatment with methylprednisolone. In some embodiments, the glucocorticoid treatment is treatment with dexamethasone. In some embodiments, the glucocorticoid treatment is treatment with betamethasone. In some embodiments, the glucocorticoid treatment is treatment with triamcinolone. In some embodiments, the glucocorticoid treatment is treatment with beclomethasone. In some embodiments, the glucocorticoid treatment is treatment with fludrocortisone acetate. In some embodiments, the glucocorticoid treatment is treatment with DOCA. In some embodiments, the glucocorticoid treatment is treatment with aldosterone. In some embodiments, the glucocorticoid treatment is treatment with budesonide. In some embodiments, the glucocorticoid treatment is treatment with mometasone furoate. In some embodiments, the glucocorticoid treatment is treatment with fluticasone propionate. In some embodiments, the glucocorticoid treatment is treatment with hydrocortisone. In some embodiments, the glucocorticoid treatment is treatment with cortisone acetate. In some embodiments, the glucocorticoid treatment is treatment with fluticasone furoate. In some embodiments, the glucocorticoid treatment is treatment with difluprednate ophthalmic. In some embodiments, the glucocorticoid treatment is treatment with fluorometholone. In some embodiments, the glucocorticoid treatment is treatment with loteprednol etabonate. In some embodiments, the glucocorticoid treatment is treatment with medrysone. In some embodiments, the glucocorticoid treatment is treatment with rimexolone. In some embodiments, the glucocorticoid treatment is treatment with fluocinolone acetonide. In some embodiments, the glucocorticoid treatment is treatment with clobetasol. In some embodiments, the glucocorticoid treatment is treatment with halobetasol. In some embodiments, the glucocorticoid treatment is treatment with diflorasone. In some embodiments, the glucocorticoid treatment is treatment with fluocinonide. In some embodiments, the glucocorticoid treatment is treatment with flurandrenolide. In some embodiments, the glucocorticoid treatment is treatment with Neo-Poly-Dex. In some embodiments, the glucocorticoid treatment is treatment with tobramycin-dexamethasone. In some embodiments, the glucocorticoid treatment is treatment with difluprednate.

In some embodiments, the ANGPTL7 inhibitor comprises an inhibitory nucleic acid molecule. In some embodiments, the inhibitory nucleic acid molecule comprises an antisense molecule, a small interfering RNA (siRNA) molecule, or a short hairpin RNA (shRNA) molecule. In some embodiments, the inhibitory nucleic acid molecule comprises an antisense molecule. In some embodiments, the inhibitory nucleic acid molecule comprises an siRNA molecule. In some embodiments, the inhibitory nucleic acid molecule comprises an shRNA molecule. Such inhibitory nucleic acid molecules can be designed to target any region of an ANGPTL7 nucleic acid molecule, such as an mRNA molecule. In some embodiments, the inhibitory nucleic acid molecule hybridizes to a sequence within an ANGPTL7 genomic nucleic acid molecule or mRNA molecule and decreases expression of the ANGPTL7 polypeptide in a cell in the subject. In some embodiments, the ANGPTL7 inhibitor comprises an antisense RNA that hybridizes to an ANGPTL7 genomic nucleic acid molecule or mRNA molecule and decreases expression of the ANGPTL7 polypeptide in a cell in the subject. In some embodiments, the ANGPTL7 inhibitor comprises an siRNA that hybridizes to an ANGPTL7 genomic nucleic acid molecule or mRNA molecule and decreases expression of the ANGPTL7 polypeptide in a cell in the subject. In some embodiments, the ANGPTL7 inhibitor comprises an shRNA that hybridizes to an ANGPTL7 genomic nucleic acid molecule or mRNA molecule and decreases expression of the ANGPTL7 polypeptide in a cell in the subject.

In some embodiments, the antisense nucleic acid molecules comprise or consist of the nucleotide sequences shown in Table 1, Table 2, and Table 3.

TABLE 1

| Sequence | SEQ ID NO: |
|---|---|
| AGCUUGAGUCUCUGACAGGG | 166 |
| UUUUCUCUCUUUCCUUGCUC | 167 |
| CCUCGCCACUUUGUUGUUUU | 168 |
| GCCUCGCCACUUUGUUGUUU | 169 |
| GGCCUCGCCACUUUGUUGUU | 170 |
| GGGCCUCGCCACUUUGUUGU | 171 |
| AGGGCCUCGCCACUUUGUUG | 172 |
| GAGGGCCUCGCCACUUUGUU | 173 |
| UGAGGGCCUCGCCACUUUGU | 174 |
| UCUGAGGGCCUCGCCACUUU | 175 |
| UUUCACUCUGAGGGCCUCGC | 176 |
| CGCUUUCACUCUGAGGGCCU | 177 |
| UACGCUUUCACUCUGAGGGC | 178 |
| UUACGCUUUCACUCUGAGGG | 179 |
| CUUACGCUUUCACUCUGAGG | 180 |
| CCUUACGCUUUCACUCUGAG | 181 |
| AACCUUACGCUUUCACUCUG | 182 |
| GAACCUUACGCUUUCACUCU | 183 |
| UGACUGAACCUUACGCUUUC | 184 |
| CUGACUGAACCUUACGCUUU | 185 |
| GCUGACUGAACCUUACGCUU | 186 |
| GGCUGACUGAACCUUACGCU | 187 |
| AGGCUGACUGAACCUUACGC | 188 |
| GGUUUGGGUGAGGAAGGCUC | 189 |
| GGGUUUGGGUGAGGAAGGCU | 190 |
| UGUGGGUUUGGGUGAGGAAG | 191 |
| UUGUGGGUUUGGGUGAGGAA | 192 |
| UUUUGUGGGUUUGGGUGAGG | 193 |
| GAAAAUGCAGAGCCAGGUCA | 194 |
| CCACGAUGAAAAUGCAGAGC | 195 |
| GCCACGAUGAAAAUGCAGAG | 196 |
| AGGCCACGAUGAAAAUGCAG | 197 |
| AAAGGCCACGAUGAAAAUGC | 198 |
| ACAAAGGCCACGAUGAAAAU | 199 |
| UGACAAAGGCCACGAUGAAA | 200 |
| CUGACAAAGGCCACGAUGAA | 201 |
| GCUGACAAAGGCCACGAUGA | 202 |
| GGCUGACAAAGGCCACGAUG | 203 |
| ACGCUGGGUGGCUGACAAAG | 204 |

TABLE 1-continued

| Sequence | SEQ ID NO: |
|---|---|
| GUGCUUAGAGAGCUUCUGCA | 205 |
| UGUGCUUAGAGAGCUUCUGC | 206 |
| UUGUGCUUAGAGAGCUUCUG | 207 |
| UCUUGUGCUUAGAGAGCUUC | 208 |
| GUCUUGUGCUUAGAGAGCUU | 209 |
| UGUCUUGUGCUUAGAGAGCU | 210 |
| GUGUCUUGUGCUUAGAGAGC | 211 |
| GGUGUCUUGUGCUUAGAGAG | 212 |
| CUGGUGUCUUGUGCUUAGAG | 213 |
| GCUGGUGUCUUGUGCUUAGA | 214 |
| UGUGCUGGUGUCUUGUGCUU | 215 |
| CUGUGCUGGUGUCUUGUGCU | 216 |
| GGCUGUGCUGGUGUCUUGUG | 217 |
| CGCUUUGAGCUGUGGCUGUG | 218 |
| CCGCUUUGAGCUGUGGCUGU | 219 |
| ACCUCCUCACAGCAGUUGGC | 220 |
| UCACCUCCUCACAGCAGUUG | 221 |
| GUUGGCAACUUGGGCCUUGA | 222 |
| GGUUGGCAACUUGGGCCUUG | 223 |
| AGGUUGGCAACUUGGGCCUU | 224 |
| AAGGUUGGCAACUUGGGCCU | 225 |
| UAAGGUUGGCAACUUGGGCC | 226 |
| CUAAGGUUGGCAACUUGGGC | 227 |
| GCUAAGGUUGGCAACUUGGG | 228 |
| UGCUAAGGUUGGCAACUUGG | 229 |
| CUGCUAAGGUUGGCAACUUG | 230 |
| GCUGCUAAGGUUGGCAACUU | 231 |
| GGCUGCUAAGGUUGGCAACU | 232 |
| AGGCUGCUAAGGUUGGCAAC | 233 |
| CAGGCUGCUAAGGUUGGCAA | 234 |
| CAGUUCACUCAGCAGGCUGC | 235 |
| UCAGUUCACUCAGCAGGCUG | 236 |
| UUCAGUUCACUCAGCAGGCU | 237 |
| GUUCAGUUCACUCAGCAGGC | 238 |
| CUUGUUCAGUUCACUCAGCA | 239 |
| UCUUGUUCAGUUCACUCAGC | 240 |
| UUCUUGUUCAGUUCACUCAG | 241 |
| GUCCCUCCUCCUGCUUCUUGU | 242 |
| AUGACCACGCUGACCCAGUC | 243 |

TABLE 1-continued

| Sequence | SEQ ID NO: |
|---|---|
| UGCAUGACCACGCUGACCCA | 244 |
| ACCUGCAUGACCACGCUGAC | 245 |
| CACCUGCAUGACCACGCUGA | 246 |
| UCACCUGCAUGACCACGCUG | 247 |
| AUCACCUGCAUGACCACGCU | 248 |
| CUCCAUCACCUGCAUGACCA | 249 |
| CGCUUGCUGUUGCUCUCCAG | 250 |
| GCGCUUGCUGUUGCUCUCCA | 251 |
| CAUGCGCUUGCUGUUGCUCU | 252 |
| CCAUGCGCUUGCUGUUGCUC | 253 |
| UCCAUGCGCUUGCUGUUGCU | 254 |
| CUCCAUGCGCUUGCUGUUGC | 255 |
| ACUCCAUGCGCUUGCUGUUG | 256 |
| GACUCCAUGCGCUUGCUGUU | 257 |
| CGACUCCAUGCGCUUGCUGU | 258 |
| GGUUGUUCAUCUCGGAGUAC | 259 |
| UGGUUGUUCAUCUCGGAGUA | 260 |
| UUGGUUGUUCAUCUCGGAGU | 261 |
| GCAUGAUGUCAAUUUGGUUG | 262 |
| AGCUGCAUGAUGUCAAUUUG | 263 |
| AGUGACCGUCUGUGCUGCCU | 264 |
| UGAGUGACCGUCUGUGCUGC | 265 |
| CUGAGUGACCGUCUGUGCUG | 266 |
| UCUGAGUGACCGUCUGUGCU | 267 |
| ACUGGUCUCCUUACCUGCGG | 268 |
| GACUGGUCUCCUUACCUGCG | 269 |
| GGACUGGUCUCCUUACCUGC | 270 |
| GAAGCAGUGCUGUAGAUGGG | 271 |
| UGUAGAAGCAGUGCUGUAGA | 272 |
| AUGUAGAAGCAGUGCUGUAG | 273 |
| UAUGUAGAAGCAGUGCUGUA | 274 |
| AUAUGUAGAAGCAGUGCUGU | 275 |
| GAUAUGUAGAAGCAGUGCUG | 276 |
| GGAUAUGUAGAAGCAGUGCU | 277 |
| AGGAUAUGUAGAAGCAGUGC | 278 |
| CCAGGAUAUGUAGAAGCAGU | 279 |
| UGACCAGGAUAUGUAGAAGC | 280 |
| GAUGACCAGGAUAUGUAGAA | 281 |
| CUGAUGACCAGGAUAUGUAG | 282 |
| UCUGAUGACCAGGAUAUGUA | 283 |
| GUUCUGAUGACCAGGAUAUG | 284 |
| GGUUCUGAUGACCAGGAUAU | 285 |
| CAGUAGUGGUUCUGAUGACC | 286 |
| CCAGUAGUGGUUCUGAUGAC | 287 |
| CCCAGUAGUGGUUCUGAUGA | 288 |
| AGUGUACCCACAAAAGAGGC | 289 |
| AAGUGUACCCACAAAAGAGG | 290 |
| AAAGUGUACCCACAAAAGAG | 291 |
| GGAAAGUGUACCCACAAAAG | 292 |
| GGGAAAGUGUACCCACAAAA | 293 |
| AAGGGAAAGUGUACCCACAA | 294 |
| CUAAAGGGAAAGUGUACCCA | 295 |
| ACUAAAGGGAAAGUGUACCC | 296 |
| UACUAAAGGGAAAGUGUACC | 297 |
| AGGAAAUACUGCAUAAGCCU | 298 |
| GUGAAGGUGUUAGGUAAACU | 299 |
| CGUGAAGGUGUUAGGUAAAC | 300 |
| CCGUGAAGGUGUUAGGUAAA | 301 |
| CCCGUGAAGGUGUUAGGUAA | 302 |
| ACCCGUGAAGGUGUUAGGUA | 303 |
| GACCCGUGAAGGUGUUAGGU | 304 |
| AGACCCGUGAAGGUGUUAGG | 305 |
| GAGACCCGUGAAGGUGUUAG | 306 |
| AGAGACCCGUGAAGGUGUUA | 307 |
| AAGAGACCCGUGAAGGUGUU | 308 |
| AAAGAGACCCGUGAAGGUGU | 309 |
| AAAAGAGACCCGUGAAGGUG | 310 |
| UAAAAGAGACCCGUGAAGGU | 311 |
| AUAAAAGAGACCCGUGAAGG | 312 |
| GAUAAAAGAGACCCGUGAAG | 313 |
| GGAUAAAAGAGACCCGUGAA | 314 |
| UGGAUAAAAGAGACCCGUGA | 315 |
| GUGGAUAAAAGAGACCCGUG | 316 |
| UGUGGAUAAAAGAGACCCGU | 317 |
| ACACUGUGGAUAAAAGAG | 318 |
| GCUGAAACACUGUGGAUA | 319 |
| GGCUGAAACACUGUGGAU | 320 |
| UAGUAUCUCAGCACUCCAAG | 321 |

TABLE 1-continued

| Sequence | SEQ ID NO: |
|---|---|
| GUAGUAUCUCAGCACUCCAA | 322 |
| AUGUAGUAUCUCAGCACUCC | 323 |
| CAUGUAGUAUCUCAGCACUC | 324 |
| CCAUGUAGUAUCUCAGCACU | 325 |
| ACCAUGUAGUAUCUCAGCAC | 326 |
| AACCAUGUAGUAUCUCAGCA | 327 |
| AAACCAUGUAGUAUCUCAGC | 328 |
| CAAACCAUGUAGUAUCUCAG | 329 |
| GCAAACCAUGUAGUAUCUC | 330 |
| UUUGGGCAAACCAUGUAGUA | 331 |
| CUUUGGGCAAACCAUGUAGU | 332 |
| UGCUUCUAAGACUUGCUGGG | 333 |
| AACCCUGCUUCUAAGACUUG | 334 |
| GAACCCUGCUUCUAAGACUU | 335 |
| UGAACCCUGCUUCUAAGACU | 336 |
| UUGAACCCUGCUUCUAAGAC | 337 |
| GACUUGAACCCUGCUUCUAA | 338 |
| AGACUUGAACCCUGCUUCUA | 339 |
| AAGACUUGAACCCUGCUUCU | 340 |
| AAUCAGGAAGACUUGAACCC | 341 |
| CAAUCAGGAAGACUUGAACC | 342 |
| CCAAUCAGGAAGACUUGAAC | 343 |
| ACCAAUCAGGAAGACUUGAA | 344 |
| ACACCAAUCAGGAAGACUUG | 345 |
| UACACCAAUCAGGAAGACUU | 346 |
| CUACACCAAUCAGGAAGACU | 347 |
| GCUACACCAAUCAGGAAGAC | 348 |
| AGCUACACCAAUCAGGAAGA | 349 |
| GAGCUACACCAAUCAGGAAG | 350 |
| AGAGCUACACCAAUCAGGAA | 351 |
| CAGAGCUACACCAAUCAGGA | 352 |
| GCAGAGCUACACCAAUCAGG | 353 |
| UGGUGAGGAAGUAGCAGAGC | 354 |
| UUGGUGAGGAAGUAGCAGAG | 355 |
| CUUGGUGAGGAAGUAGCAGA | 356 |
| UCUUGGUGAGGAAGUAGCAG | 357 |
| CUCUUGGUGAGGAAGUAGCA | 358 |
| GCUCUUGGUGAGGAAGUAGC | 359 |
| UGUCAGCUCUUGGUGAGGAA | 360 |

TABLE 1-continued

| Sequence | SEQ ID NO: |
|---|---|
| CUGUCAGCUCUUGGUGAGGA | 361 |
| AGCCUGUCAGCUCUUGGUGA | 362 |
| UAUAGCCUGUCAGCUCUUGG | 363 |
| AUAUAGCCUGUCAGCUCUUG | 364 |
| AGAUAUAGCCUGUCAGCUCU | 365 |
| UCUUGAGAUAUAGCCUGUCA | 366 |
| UUCUUGAGAUAUAGCCUGUC | 367 |
| GGUGCUUCCUUGGAAUUUCU | 368 |
| AGUUUGGUGCUUCCUUGGAA | 369 |
| CAGUUUGGUGCUUCCUUGGA | 370 |
| UACAGUUUGGUGCUUCCUUG | 371 |
| GUUACAGUUUGGUGCUUCCU | 372 |
| UGUUACAGUUUGGUGCUUCC | 373 |
| CUGUUACAGUUUGGUGCUUC | 374 |
| GCUGUUACAGUUUGGUGCUU | 375 |
| AGCUGUUACAGUUUGGUGCU | 376 |
| CUUAGGAACACCAGAGAACU | 377 |
| UCUUAGGAACACCAGAGAAC | 378 |
| AUCUUAGGAACACCAGAGAA | 379 |
| AAUCUUAGGAACACCAGAGA | 380 |
| GUAAAUCUUAGGAACACCAG | 381 |
| UGGUAAAUCUUAGGAACACC | 382 |
| CUGGUAAAUCUUAGGAACAC | 383 |
| CCUGGUAAAUCUUAGGAACA | 384 |
| CAUUCCUGGUAAAUCUUAGG | 385 |
| GCUCAUUCCUGGUAAAUCUU | 386 |
| UGCUCAUUCCUGGUAAAUCU | 387 |
| AUGCUCAUUCCUGGUAAAUC | 388 |
| CGUUUACAGAGAGGACAC | 389 |
| UACGUUUACAGAGAGGAC | 390 |
| GUUACGUUUACAGAGAGG | 391 |
| AGUUACGUUUACAGAGAGAG | 392 |
| GAGUUACGUUUACAGAGAGA | 393 |
| AGAGUUACGUUUACAGAGAG | 394 |
| GAAGAGUUACGUUUACAGAG | 395 |
| GAGAAGAGUUACGUUUACAG | 396 |
| CCAAUGAGAAGAGUUACGUU | 397 |
| GCCAAUGAGAAGAGUUACGU | 398 |
| GAGCCAAUGAGAAGAGUUAC | 399 |

TABLE 1-continued

| Sequence | SEQ ID NO: |
|---|---|
| UGAGCCAAUGAGAAGAGUUA | 400 |
| CUACACUUAACUCUGAGCCA | 401 |
| UCUACACUUAACUCUGAGCC | 402 |
| CUCUACACUUAACUCUGAGC | 403 |
| UCUCUACACUUAACUCUGAG | 404 |
| UGUCUCUACACUUAACUCUG | 405 |
| CAUGGUUAUGUGUCUCUACA | 406 |
| GGACUCUUCACAUGGUUAUG | 407 |
| GGGACUCUUCACAUGGUUAU | 408 |
| AAGGGACUCUUCACAUGGUU | 409 |
| ACAAAGGGACUCUUCACAUG | 410 |
| AACACAAAGGGACUCUUCAC | 411 |
| GAACACAAAGGGACUCUUCA | 412 |
| UCCUGAACACAAAGGGACUC | 413 |
| CUUCCUGAACACAAAGGGAC | 414 |
| CAUCCUUCCUGAACACAAAG | 415 |
| GCAUCCUUCCUGAACACAAA | 416 |
| CCGCAUCCUUCCUGAACACA | 417 |
| AGCCGCAUCCUUCCUGAACA | 418 |
| GAGCCGCAUCCUUCCUGAAC | 419 |
| CCUGUAUUCGGAGAAAUUCA | 420 |
| UCCUGUAUUCGGAGAAAUUC | 421 |
| GAGCUGAGCUAACCAGAAAU | 422 |
| UGAGCUGAGCUAACCAGAAA | 423 |
| CUGAGCUGAGCUAACCAGAA | 424 |
| CCUGAGCUGAGCUAACCAGA | 425 |
| ACCUGAGCUGAGCUAACCAG | 426 |
| CCACCUGAGCUGAGCUAACC | 427 |
| CCCACCUGAGCUGAGCUAAC | 428 |
| UGUUGGCCCACCUGAGCUGA | 429 |
| AUGUUGGCCCACCUGAGCUG | 430 |
| UUCAUGUUGGCCCACCUGAG | 431 |
| AUUCAUGUUGGCCCACCUGA | 432 |
| AAAUUCAUGUUGGCCCACCU | 433 |
| UAAAUUCAUGUUGGCCCACC | 434 |
| GUAAAUUCAUGUUGGCCCAC | 435 |
| GUUGGUUCAGGUAACAGAAU | 436 |
| CCAUGCUUAGAAAGUGAUUG | 437 |
| AAGUCCAUGCUUAGAAAGUG | 438 |

TABLE 1-continued

| Sequence | SEQ ID NO: |
|---|---|
| GGAAGUCCAUGCUUAGAAAG | 439 |
| CGGAAGUCCAUGCUUAGAAA | 440 |
| CCGGAAGUCCAUGCUUAGAA | 441 |
| CCCGGAAGUCCAUGCUUAGA | 442 |
| UUUCUAAUCCCAAACUGAGG | 443 |
| CUUUCUAAUCCCAAACUGAG | 444 |
| CCUUUCUAAUCCCAAACUGA | 445 |
| ACCUUUCUAAUCCCAAACUG | 446 |
| AUGGCCUGAGAAUACCUUUC | 447 |
| AAUGGCCUGAGAAUACCUUU | 448 |
| AAAUGGCCUGAGAAUACCUU | 449 |
| AAAAUGGCCUGAGAAUACCU | 450 |
| UGGAAAAUGGCCUGAGAAUA | 451 |
| ACUUGUCUGGAAAAUGGCCU | 452 |
| CACUUGUCUGGAAAAUGGCC | 453 |
| UCACUUGUCUGGAAAAUGGC | 454 |
| GGACUCACUUGUCUGGAAAA | 455 |
| AAUCAGGACUCACUUGUCUG | 456 |
| AAAUCAGGACUCACUUGUCU | 457 |
| CAAAUCAGGACUCACUUGUC | 458 |
| CCAAAUCAGGACUCACUUGU | 459 |
| GACCAAAUCAGGACUCACUU | 460 |
| AGACCAAAUCAGGACUCACU | 461 |
| CAGACCAAAUCAGGACUCAC | 462 |
| CACAGACCAAAUCAGGACUC | 463 |
| UCACAGACCAAAUCAGGACU | 464 |
| CUCACAGACCAAAUCAGGAC | 465 |
| UCUCACAGACCAAAUCAGGA | 466 |
| AUCUCACAGACCAAAUCAGG | 467 |
| CAUCUCACAGACCAAAUCAG | 468 |
| GUUUCAUCUCACAGACCAAA | 469 |
| GGUUUCAUCUCACAGACCAA | 470 |
| CUGGUUUCAUCUCACAGACC | 471 |
| CAUGUCUGGUUUCAUCUCAC | 472 |
| GCAUGUCUGGUUUCAUCUCA | 473 |
| CGCAUGUCUGGUUUCAUCUC | 474 |
| UCCGCAUGUCUGGUUUCAUC | 475 |
| UUCCGCAUGUCUGGUUUCAU | 476 |
| CUUCCGCAUGUCUGGUUUCA | 477 |

TABLE 1-continued

| Sequence | SEQ ID NO: |
|---|---|
| UCUUCCGCAUGUCUGGUUUC | 478 |
| GUCUUCCGCAUGUCUGGUUU | 479 |
| GGUCUUCCGCAUGUCUGGUU | 480 |
| UGGUCUUCCGCAUGUCUGGU | 481 |
| CUGGUCUUCCGCAUGUCUGG | 482 |
| CCUGGUCUUCCGCAUGUCUG | 483 |
| GCCUGGUCUUCCGCAUGUCU | 484 |
| UGGCCUGGUCUUCCGCAUGU | 485 |
| UCUGUCUGGCCUGGUCUUCC | 486 |
| CUCUGUCUGGCCUGGUCUUC | 487 |
| CCUCUGUCUGGCCUGGUCUU | 488 |
| AUUCCUCUGUCUGGCCUGGU | 489 |
| GAUUCCUCUGUCUGGCCUGG | 490 |
| AGAUUCCUCUGUCUGGCCUG | 491 |
| UGGCACGGUCAGAUUCCUCU | 492 |
| GUGGCACGGUCAGAUUCCUC | 493 |
| AGUGGCACGGUCAGAUUCCU | 494 |
| AAGUGGCACGGUCAGAUUCC | 495 |
| GAAGUGGCACGGUCAGAUUC | 496 |
| GGAAGUGGCACGGUCAGAUU | 497 |
| AGGAAGUGGCACGGUCAGAU | 498 |
| CAGGAAGUGGCACGGUCAGA | 499 |
| AGCAGGAAGUGGCACGGUCA | 500 |
| GUUUGGAUGAGCAGGAAGUG | 501 |
| UGUUUGGAUGAGCAGGAAGU | 502 |
| CCUCCUGUUUGGAUGAGCAG | 503 |
| GCCUCCUGUUUGGAUGAGCA | 504 |
| AGCCUCCUGUUUGGAUGAGC | 505 |
| AAGCCUCCUGUUUGGAUGAG | 506 |
| AAAGCCUCCUGUUUGGAUGA | 507 |
| GAAAGCCUCCUGUUUGGAUG | 508 |
| UGAGAAAGCCUCCUGUUUGG | 509 |
| GUGAGAAAGCCUCCUGUUUG | 510 |
| GGUGAGAAAGCCUCCUGUUU | 511 |
| AUGGUGAGAAAGCCUCCUGU | 512 |
| CAGGAUGGUGAGAAAGCCUC | 513 |
| GCAGGAUGGUGAGAAAGCCU | 514 |
| UGGGAGAGCUGCACUUGACC | 515 |
| GUGGGAGAGCUGCACUUGAC | 516 |

TABLE 1-continued

| Sequence | SEQ ID NO: |
|---|---|
| GGUGGGAGAGCUGCACUUGA | 517 |
| UGGUGGGAGAGCUGCACUUG | 518 |
| CUGGUGGGAGAGCUGCACUU | 519 |
| AUGAUGUCCUGGGCAAGAAG | 520 |
| AAUGAUGUCCUGGGCAAGAA | 521 |
| GAAUGAUGUCCUGGGCAAGA | 522 |
| GGAAUGAUGUCCUGGGCAAG | 523 |
| GAAUAUAAGGGUAACUGAGC | 524 |
| GGGACUACCACUUAUAGAA | 525 |
| AGGGACUACCACUUAUAGA | 526 |
| UGAAAGCACCAACUUACUGC | 527 |
| GUGAAAGCACCAACUUACUG | 528 |
| CGUCUUAGUGGUGAAAGCAC | 529 |
| UCGUCUUAGUGGUGAAAGCA | 530 |
| UUCGUCUUAGUGGUGAAAGC | 531 |
| CAUUUCGUCUUAGUGGUGAA | 532 |
| UCAUUUCGUCUUAGUGGUGA | 533 |
| UUCAUUUCGUCUUAGUGGUG | 534 |
| CUUCAUUUCGUCUUAGUGGU | 535 |
| UCUUCAUUUCGUCUUAGUGG | 536 |
| AGGUAGAGUACGUGUGCCUU | 537 |
| GAGGUAGAGUACGUGUGCCU | 538 |
| GGAGGUAGAGUACGUGUGCC | 539 |
| GGGAGGUAGAGUACGUGUGC | 540 |
| AGGGAGGUAGAGUACGUGUG | 541 |
| AAGGGAGGUAGAGUACGUGU | 542 |
| AAAGGGAGGUAGAGUACGUG | 543 |
| GAAAGGGAGGUAGAGUACGU | 544 |
| CACAUAGGUUCUCUUGCAGA | 545 |
| AGGCACAUAGGUUCUCUUGC | 546 |
| GAGGCACAUAGGUUCUCUUG | 547 |
| CUGAGGCACAUAGGUUCUCU | 548 |
| UCUGAGGCACAUAGGUUCUC | 549 |
| GUCUGAGGCACAUAGGUUCU | 550 |
| UGUCUGAGGCACAUAGGUUC | 551 |
| UUGUCUGAGGCACAUAGGUU | 552 |
| UAGAGAGGAGCACCAAGAUG | 553 |
| UUAGAGAGGAGCACCAAGAU | 554 |
| CUUAGAGAGGAGCACCAAGA | 555 |

TABLE 1-continued

| Sequence | SEQ ID NO: |
|---|---|
| ACCUUAGAGAGGAGCACCAA | 556 |
| GACCUUAGAGAGGAGCACCA | 557 |
| GGACCUUAGAGAGGAGCACC | 558 |
| UGGGACCUUAGAGAGGAGCA | 559 |
| CUGGGACCUUAGAGAGGAGC | 560 |
| CACUGGGACCUUAGAGAGGA | 561 |
| GCACUGGGACCUUAGAGAGG | 562 |
| UGCACUGGGACCUUAGAGAG | 563 |
| ACUGCACUGGGACCUUAGAG | 564 |
| GACCACUGCACUGGGACCUU | 565 |
| UUGGUGACCACUGCACUGGG | 566 |
| CUUGGUGACCACUGCACUGG | 567 |
| UCUUGGUGACCACUGCACUG | 568 |
| UUCUUGGUGACCACUGCACU | 569 |
| UUUCUUGGUGACCACUGCAC | 570 |
| CUUUUCUUGGUGACCACUGC | 571 |
| GGUGCUUUUCUUGGUGACCA | 572 |
| GGGUGCUUUUCUUGGUGACC | 573 |
| AGCUUCCUGCCUGCUAUGUC | 574 |
| ACAGCCUUUUCUGAUAGGAU | 575 |
| GACAGCCUUUUCUGAUAGGA | 576 |
| GAAGAGACAGCCUUUUCUGA | 577 |
| GGAAGAGACAGCCUUUUCUG | 578 |
| AUAGUGGAAGAGACAGCCUU | 579 |
| GCAUAGUGGAAGAGACAGCC | 580 |
| AGCAUAGUGGAAGAGACAGC | 581 |
| GAGCAUAGUGGAAGAGACAG | 582 |
| AAGAGCAUAGUGGAAGAGAC | 583 |
| UAUGCAGGAUUUAAGCUCUG | 584 |
| UGGAGCUGCUACUUUAUGCA | 585 |
| AUGAGAGCAUCAGACUGGCC | 586 |
| AAUGAGAGCAUCAGACUGGC | 587 |
| CCUCCCAGAAGUUUUGUUAA | 588 |
| UCCUCCCAGAAGUUUUGUUA | 589 |
| UCAGAAGAACCUUUGAGGCC | 590 |
| ACACUCAGAAGAACCUUUGA | 591 |
| AACACUCAGAAGAACCUUUG | 592 |
| UAGCACCUCAAAACACUCAG | 593 |
| CUAGCACCUCAAAACACUCA | 594 |
| UGCCACCUGAGACCAUAAUU | 595 |
| ACUGCCACCUGAGACCAUAA | 596 |
| UACUGCCACCUGAGACCAUA | 597 |
| CAGAGAUGGUGGCUACUGCC | 598 |
| UCAGAGAUGGUGGCUACUGC | 599 |
| GUUCAGAGAUGGUGGCUACU | 600 |
| UGUUCAGAGAUGGUGGCUAC | 601 |
| UGUUGUUCAGAGAUGGUGGC | 602 |
| UUGUUGUUCAGAGAUGGUGG | 603 |
| GUUGUUGUUCAGAGAUGGUG | 604 |
| AUGUUUCCUGGUUGGUUGUU | 605 |
| UCUCAUAGAGUCUGGUUUUG | 606 |
| GAAUAUCUCAUAGAGUCUGG | 607 |
| GUCGUGAAUAUCUCAUAGAG | 608 |
| CAGUCGUGAAUAUCUCAUAG | 609 |
| CCACUAUAACAAAUCAGUCG | 610 |
| GCCACUAUAACAAAUCAGUC | 611 |
| CCGCCACUAUAACAAAUCAG | 612 |
| CAGACUUCUUAGACAGCCGC | 613 |
| UCAGACUUCUUAGACAGCCG | 614 |
| UUCAGACUUCUUAGACAGCC | 615 |
| AUUCAGACUUCUUAGACAGC | 616 |
| GUCAGAUAGAUUCAGACUUC | 617 |
| CUGUCAGAUAGAUUCAGACU | 618 |
| UCCUGUCAGAUAGAUUCAGA | 619 |
| CUCCUGUCAGAUAGAUUCAG | 620 |
| ACUCCUGUCAGAUAGAUUCA | 621 |
| UACUCCUGUCAGAUAGAUUC | 622 |
| GAUACUCCUGUCAGAUAGAU | 623 |
| AGAUACUCCUGUCAGAUAGA | 624 |
| CCACGUAACAGAUACUCCUG | 625 |
| GCCACGUAACAGAUACUCCU | 626 |
| GGCCACGUAACAGAUACUCC | 627 |
| GGGCCACGUAACAGAUACUC | 628 |
| AGGGCCACGUAACAGAUACU | 629 |
| GAGGGCCACGUAACAGAUAC | 630 |
| UGAGGGCCACGUAACAGAUA | 631 |
| AUGAGGGCCACGUAACAGAU | 632 |
| UAUGAGGGCCACGUAACAGA | 633 |

TABLE 1-continued

| Sequence | SEQ ID NO: |
|---|---|
| GUAUGAGGGCCACGUAACAG | 634 |
| UGUAUGAGGGCCACGUAACA | 635 |
| GUGUAUGAGGGCCACGUAAC | 636 |
| AGUGUAUGAGGGCCACGUAA | 637 |
| UACAGUGUAUGAGGGCCACG | 638 |
| UUACAGUGUAUGAGGGCCAC | 639 |
| GUUACAGUGUAUGAGGGCCA | 640 |
| AUGUUACAGUGUAUGAGGGC | 641 |
| AACAGGUGGUUUCAGGUUAA | 642 |
| ACGUUCCAACAGGUGGUUUC | 643 |
| GACGUUCCAACAGGUGGUUU | 644 |
| GGACGUUCCAACAGGUGGUU | 645 |
| GGGACGUUCCAACAGGUGGU | 646 |
| UGGGACGUUCCAACAGGUGG | 647 |
| GUGGGACGUUCCAACAGGUG | 648 |
| AGUGGGACGUUCCAACAGGU | 649 |
| UAGUGGGACGUUCCAACAGG | 650 |
| UUAGUGGGACGUUCCAACAG | 651 |
| AUUAGUGGGACGUUCCAACA | 652 |
| CAUUAGUGGGACGUUCCAAC | 653 |
| GCAUUAGUGGGACGUUCCAA | 654 |
| AGCAUUAGUGGGACGUUCCA | 655 |
| UAGCAUUAGUGGGACGUUCC | 656 |
| AUAGCAUUAGUGGGACGUUC | 657 |
| GAUAGCAUUAGUGGGACGUU | 658 |
| GGAUAGCAUUAGUGGGACGU | 659 |
| UGGAUAGCAUUAGUGGGACG | 660 |
| CUGGAUAGCAUUAGUGGGAC | 661 |
| CCUGGAUAGCAUUAGUGGGA | 662 |
| ACCUGGAUAGCAUUAGUGGG | 663 |
| CACCUGGAUAGCAUUAGUGG | 664 |
| UCACCUGGAUAGCAUUAGUG | 665 |
| UUCACCUGGAUAGCAUUAGU | 666 |
| CUUCACCUGGAUAGCAUUAG | 667 |
| CCUUCACCUGGAUAGCAUUA | 668 |
| CCCUUCACCUGGAUAGCAUU | 669 |
| AGCCCUUCACCUGGAUAGCA | 670 |
| AAGCCCUUCACCUGGAUAGC | 671 |
| GAAGCCCUUCACCUGGAUAG | 672 |

TABLE 1-continued

| Sequence | SEQ ID NO: |
|---|---|
| UACUAGCGGUGGAGCAGAGG | 673 |
| UUACUAGCGGUGGAGCAGAG | 674 |
| UUUACUAGCGGUGGAGCAGA | 675 |
| CUUUACUAGCGGUGGAGCAG | 676 |
| GCUUUACUAGCGGUGGAGCA | 677 |
| GGCUUUACUAGCGGUGGAGC | 678 |
| UGGCUUUACUAGCGGUGGAG | 679 |
| UUGGCUUUACUAGCGGUGGA | 680 |
| UUUGGCUUUACUAGCGGUGG | 681 |
| UUUUGGCUUUACUAGCGGUG | 682 |
| AUUUUGGCUUUACUAGCGGU | 683 |
| UAUUUUGGCUUUACUAGCGG | 684 |
| GUAUUUUGGCUUUACUAGCG | 685 |
| GGGUGUAUUUUGGCUUUACU | 686 |
| UUGGGAGAGGUGGAUAUGGG | 687 |
| UGCAUUUGGGAGAGGUGGAU | 688 |
| CAGUGUCUGCAUUUGGGAGA | 689 |
| UACCCAUCAGUGUCUGCAUU | 690 |
| AUUACCCAUCAGUGUCUGCA | 691 |
| AAUUACCCAUCAGUGUCUGC | 692 |
| CUACCCUGGGAUUCUCAGUG | 693 |
| UUCUACCCUGGGAUUCUCAG | 694 |
| UUUCUACCCUGGGAUUCUCA | 695 |
| AUUUCUACCCUGGGAUUCUC | 696 |
| UAUUUCUACCCUGGGAUUCU | 697 |
| UUAUUUCUACCCUGGGAUUC | 698 |
| CUUUAUUUCUACCCUGGGAU | 699 |
| AGCCUUUAUUUCUACCCUGG | 700 |
| ACUGAGCCUUUAUUUCUACC | 701 |
| GACUGAGCCUUUAUUUCUAC | 702 |
| GUUUAGAGACUGAGCCUUUA | 703 |
| UGUUUAGAGACUGAGCCUUU | 704 |
| GUGUUUAGAGACUGAGCCUU | 705 |
| GAGUGUUUAGAGACUGAGCC | 706 |
| UGAGUGUUUAGAGACUGAGC | 707 |
| UUGAGUGUUUAGAGACUGAG | 708 |
| AGUUGAGUGUUUAGAGACUG | 709 |
| GAGUUGAGUGUUUAGAGACU | 710 |
| UGAGUUGAGUGUUUAGAGAC | 711 |

TABLE 1-continued

| Sequence | SEQ ID NO: |
|---|---|
| UCUGAGUUGAGUGUUUAGAG | 712 |
| CCAUCUGAGUUGAGUGUUUA | 713 |
| UCCAUCUGAGUUGAGUGUUU | 714 |
| GCUCCAUCUGAGUUGAGUGU | 715 |
| ACCCAGUGGCUCCAUCUGAG | 716 |
| UUUAGACCCAGUGGCUCCAU | 717 |
| AUUUAGACCCAGUGGCUCCA | 718 |
| CAUUUAGACCCAGUGGCUCC | 719 |
| UGAGCAUUUAGACCCAGUGG | 720 |
| GUGAGCAUUUAGACCCAGUG | 721 |
| GGUGAGCAUUUAGACCCAGU | 722 |
| ACAGGGUGAGCAUUUAGACC | 723 |
| ACCACAGGGUGAGCAUUUAG | 724 |
| AAACCACAGGGUGAGCAUUU | 725 |
| GAACAAACCACAGGGUGAGC | 726 |
| AGAACAAACCACAGGGUGAG | 727 |
| AAGAGAACAAACCACAGGGU | 728 |
| GAGCAGUCGUAGAUGGCAUC | 729 |
| AGAGCAGUCGUAGAUGGCAU | 730 |
| AAGAGCAGUCGUAGAUGGCA | 731 |
| GAAGAGCAGUCGUAGAUGGC | 732 |
| GGAAGAGCAGUCGUAGAUGG | 733 |
| GGGAAGAGCAGUCGUAGAUG | 734 |
| AGGGAAGAGCAGUCGUAGAU | 735 |
| GAGGGAAGAGCAGUCGUAGA | 736 |
| GGUAGUUCUUCUGGUAGAGG | 737 |
| AGCUUAUACACUCCAGAGAU | 738 |
| GAAGUCAUCAGGAGGAAGCU | 739 |
| GGAAGUCAUCAGGAGGAAGC | 740 |
| GCCCAGGAAGUCAUCAGGAG | 741 |
| GCUGCCCAGGAAGUCAUCAG | 742 |
| AGUUCAGGGCUGCCCAGGAA | 743 |
| CUCACCUCCAGUUCAGGGCU | 744 |
| ACCUCACCUCCAGUUCAGGG | 745 |
| UAAUGACCUCACCUCCAGUU | 746 |
| GUAAUGACCUCACCUCCAGU | 747 |
| CUGUAAUGACCUCACCUCCA | 748 |
| UGACUGUAAUGACCUCACCU | 749 |
| CCAGUGACUGUAAUGACCUC | 750 |
| GACAGGUAUUAGGGCAUGGC | 751 |
| GGACAGGUAUUAGGGCAUGG | 752 |
| AGGACAGGUAUUAGGGCAUG | 753 |
| AAGGACAGGUAUUAGGGCAU | 754 |
| GGCCCUGUUGUUGUAGUCCC | 755 |
| UGGCCCUGUUGUUGUAGUCC | 756 |
| AUGGCCCUGUUGUUGUAGUC | 757 |
| AAUGGCCCUGUUGUUGUAGU | 758 |
| GAAUGGCCCUGUUGUUGUAG | 759 |
| GUGAAUGGCCCUGUUGUUGU | 760 |
| UGUGAAUGGCCCUGUUGUUG | 761 |
| ACUGUGAAUGGCCCUGUUGU | 762 |
| UUAAACUGUGAAUGGCCCUG | 763 |
| CAGCCGAAUUUUCCUUUCUU | 764 |
| CCCAGCCGAAUUUUCCUUUC | 765 |
| CCAUAGUGCUGGGAUUACAG | 766 |
| AAGUGAUCCACCUGCCUCGG | 767 |
| GAAGUGAUCCACCUGCCUCG | 768 |
| UGAAGUGAUCCACCUGCCUC | 769 |
| CUGAAGUGAUCCACCUGCCU | 770 |
| CCUGAAGUGAUCCACCUGCC | 771 |
| ACCUGAAGUGAUCCACCUGC | 772 |
| GGCCAGGCUGGUCUUAAACU | 773 |
| AGGGUUUCACCAUGUUGGCC | 774 |
| CAGGGUUUCACCAUGUUGGC | 775 |
| ACAGGGUUUCACCAUGUUGG | 776 |
| GACAGGGUUUCACCAUGUUG | 777 |
| AGACAGGGUUUCACCAUGUU | 778 |
| GAGACAGGGUUUCACCAUGU | 779 |
| AGAGACAGGGUUUCACCAUG | 780 |
| UAGAGACAGGGUUUCACCAU | 781 |
| GUAGAGACAGGGUUUCACCA | 782 |
| CACCAUGCCUGGCUAAUUUU | 783 |
| CCACCAUGCCUGGCUAAUUU | 784 |
| ACCACCAUGCCUGGCUAAUU | 785 |
| CACCACCAUGCCUGGCUAAU | 786 |
| CCACCACCAUGCCUGGCUAA | 787 |
| AACCUCUGCCUCCUGAGUUC | 788 |
| CAACCUCUGCCUCCUGAGUU | 789 |

TABLE 1-continued

| Sequence | SEQ ID NO: |
|---|---|
| GCAACCUCUGCCUCCUGAGU | 790 |
| UGCAACCUCUGCCUCCUGAG | 791 |
| CUGCAACCUCUGCCUCCUGA | 792 |
| ACUGCAACCUCUGCCUCCUG | 793 |
| CACUGCAACCUCUGCCUCCU | 794 |
| UCACUGCAACCUCUGCCUCC | 795 |
| CUCACUGCAACCUCUGCCUC | 796 |
| GCUCACUGCAACCUCUGCCU | 797 |
| UCGGCUCACUGCAACCUCUG | 798 |
| CUCGGCUCACUGCAACCUCU | 799 |
| UCUCGGCUCACUGCAACCUC | 800 |
| AUCUCGGCUCACUGCAACCU | 801 |
| GAUCUCGGCUCACUGCAACC | 802 |
| UGAUCUCGGCUCACUGCAAC | 803 |
| AGUGGCGUGAUCUCGGCUCA | 804 |
| AGUGCAGUGGCGUGAUCUCG | 805 |
| UAGUGCAGUGGCGUGAUCUC | 806 |
| AUAGUGCAGUGGCGUGAUCU | 807 |
| UAUAGUGCAGUGGCGUGAUC | 808 |
| UUAUAGUGCAGUGGCGUGAU | 809 |
| AUUAUAGUGCAGUGGCGUGA | 810 |
| GAUUAUAGUGCAGUGGCGUG | 811 |
| CAGAUUAUAGUGCAGUGGCG | 812 |
| GUCUCCCAGAUUAUAGUGCA | 813 |
| UGUCUCCCAGAUUAUAGUGC | 814 |
| UUGUCUCCCAGAUUAUAGUG | 815 |
| GCUUGUGUUUGAGUUUUCCU | 816 |
| UGCUUGUGUUUGAGUUUUCC | 817 |
| GGUGUUUGGUGUGUUUGCUU | 818 |
| CUGUGGUGUUUGGUGUGUUU | 819 |
| AGCUCUGUGGUGUUUGGUGU | 820 |
| AUAGCUCUGUGGUGUUUGGU | 821 |
| UUGCAUAGCUCUGUGGUGUU | 822 |
| UUUGCAUAGCUCUGUGGUGU | 823 |
| GUUUGCAUAGCUCUGUGGUG | 824 |
| GAGUGUUUGCAUAGCUCUGU | 825 |
| CUGAGUGUUUGCAUAGCUCU | 826 |
| ACUGAGUGUUUGCAUAGCUC | 827 |
| UGCAGGGCAUAAACUGAGUG | 828 |
| AGUGCAGGGCAUAAACUGAG | 829 |
| GAGUGCAGGGCAUAAACUGA | 830 |
| GGAGUGCAGGGCAUAAACUG | 831 |
| UGGAGUGCAGGGCAUAAACU | 832 |
| AUGCCUGGGUUUGGAGUGCA | 833 |
| GCCAAACAGAUGCCUGGGUU | 834 |
| AAUAGCUGUUCUAGGACAUG | 835 |
| GAAUAGCUGUUCUAGGACAU | 836 |
| CAAGGAAUAGCUGUUCUAGG | 837 |
| CCCAAGGAAUAGCUGUUCUA | 838 |
| CCUUCGUGUUUUCUUUUCUC | 839 |
| GCCUUCGUGUUUUCUUUUCU | 840 |
| UGCCUUCGUGUUUUCUUUUC | 841 |
| CUGCCUUCGUGUUUUCUUUU | 842 |
| GCUGCCUUCGUGUUUUCUUU | 843 |
| UGCUGCCUUCGUGUUUUCUU | 844 |
| AUGCUGCCUUCGUGUUUUCU | 845 |
| UUGAUGCUGCCUUCGUGUUU | 846 |
| UUUGAUGCUGCCUUCGUGUU | 847 |
| AUUUGAUGCUGCCUUCGUGU | 848 |
| AUAAUUUGAUGCUGCCUUCG | 849 |
| GAUAAUUUGAUGCUGCCUUC | 850 |
| CAGAUAAUUUGAUGCUGCCU | 851 |
| CCAGAUAAUUUGAUGCUGCC | 852 |
| UCCAGAUAAUUUGAUGCUGC | 853 |
| ACCAUGCCUGGGUGAAAAUC | 854 |
| GGAUUACAGGUGUGAGCCAC | 855 |
| GGGAUUACAGGUGUGAGCCA | 856 |
| UGGGAUUACAGGUGUGAGCC | 857 |
| UUGGGAUUACAGGUGUGAGC | 858 |
| CUUGGGAUUACAGGUGUGAG | 859 |
| ACUUGGGAUUACAGGUGUGA | 860 |
| AACUUGGGAUUACAGGUGUG | 861 |
| AAACUUGGGAUUACAGGUGU | 862 |
| AAAACUUGGGAUUACAGGUG | 863 |
| CCUCAGGUGAUUGUUCCGCC | 864 |
| ACCUCAGGUGAUUGUUCCGC | 865 |
| GACCUCAGGUGAUUGUUCCG | 866 |
| UGACCUCAGGUGAUUGUUCC | 867 |

TABLE 1-continued

| Sequence | SEQ ID NO: |
|---|---|
| CUGACCUCAGGUGAUUGUUC | 868 |
| CAGGCUGGUCUCAAAGUCCU | 869 |
| CCAGGCUGGUCUCAAAGUCC | 870 |
| GCCAGGCUGGUCUCAAAGUC | 871 |
| GGCCAGGCUGGUCUCAAAGU | 872 |
| AGUAGCUGGGACCAGAGUGC | 873 |
| UUCCAGUGAUUCUCCUGCCU | 874 |
| GUUCCAGUGAUUCUCCUGCC | 875 |
| AACCUCCACCUCCUGAGUUC | 876 |
| CAACCUCCACCUCCUGAGUU | 877 |
| GCAACCUCCACCUCCUGAGU | 878 |
| UGCAACCUCCACCUCCUGAG | 879 |
| CUGCAACCUCCACCUCCUGA | 880 |
| ACUGCAACCUCCACCUCCUG | 881 |
| CACUGCAACCUCCACCUCCU | 882 |
| UCACUGCAACCUCCACCUCC | 883 |
| CUCACUGCAACCUCCACCUC | 884 |
| GCUCACUGCAACCUCCACCU | 885 |
| UCGGCUCACUGCAACCUCCA | 886 |
| UCUCGGCUCACUGCAACCUC | 887 |
| AUCUCGGCUCACUGCAACCU | 888 |
| AAUCUCGGCUCACUGCAACC | 889 |
| CAAUCUCGGCUCACUGCAAC | 890 |
| GCAAUCUCGGCUCACUGCAA | 891 |
| GUGCAAUCUCGGCUCACUGC | 892 |
| GGUGCAAUCUCGGCUCACUG | 893 |
| UGGUGCAAUCUCGGCUCACU | 894 |
| GUGGUGCAAUCUCGGCUCAC | 895 |
| AGUGGUGCAAUCUCGGCUCA | 896 |
| CAGUGGUGCAAUCUCGGCUC | 897 |
| ACAGUGGUGCAAUCUCGGCU | 898 |
| UACAGUGGUGCAAUCUCGGC | 899 |
| GUACAGUGGUGCAAUCUCGG | 900 |
| AGUACAGUGGUGCAAUCUCG | 901 |
| GAGUACAGUGGUGCAAUCUC | 902 |
| UGCCCAGGCUAGAGUACAGU | 903 |
| UUGCCCAGGCUAGAGUACAG | 904 |
| AGAACGAUGCAAAUUGGGCC | 905 |
| AAGAACGAUGCAAAUUGGGC | 906 |

TABLE 1-continued

| Sequence | SEQ ID NO: |
|---|---|
| GAAGAACGAUGCAAAUUGGG | 907 |
| GGAAGAACGAUGCAAAUUGG | 908 |
| UGGAAGAACGAUGCAAAUUG | 909 |
| CUGGAAGAACGAUGCAAAUU | 910 |
| UCUGGAAGAACGAUGCAAAU | 911 |
| CUCUGGAAGAACGAUGCAAA | 912 |
| GCUCUGGAAGAACGAUGCAA | 913 |
| UGCUCUGGAAGAACGAUGCA | 914 |
| UUGCUCUGGAAGAACGAUGC | 915 |
| GCAUUGCUCUGGAAGAACGA | 916 |
| UGCAUUGCUCUGGAAGAACG | 917 |
| GUGCAUUGCUCUGGAAGAAC | 918 |
| UGGGUGGUGCAUUGCUCUGG | 919 |
| AGUCACACUGGCUCACUCGG | 920 |
| UGCACUCCCGCAGUCACACU | 921 |
| AGAGCCAGUAGAUGUGUGCA | 922 |
| UGCAGAGCCAGUAGAUGUGU | 923 |
| AACCUGUUCCUGUCCCUGCA | 924 |
| CAACCUGUUCCUGUCCCUGC | 925 |
| CCAACCUGUUCCUGUCCCUG | 926 |
| CCCAACCUGUUCCUGUCCCU | 927 |
| AAGAGGGCAGGCUUCCCAAC | 928 |
| AGGAGCAAGAGGGCAGGCUU | 929 |
| CAGAAGGCAGGAGCAAGAGG | 930 |
| CUCUGGUGAGGGACUUGCAG | 931 |
| ACUCUGGUGAGGGACUUGCA | 932 |
| UACUCUGGUGAGGGACUUGC | 933 |
| AUACUCUGGUGAGGGACUUG | 934 |
| GGGAUACUCUGGUGAGGGAC | 935 |
| CAGAACACCUGAAGCAGAGG | 936 |
| CCGCCUGAAGUCUCCAUGUC | 937 |
| UCCGCCUGAAGUCUCCAUGU | 938 |
| CUCCGCCUGAAGUCUCCAUG | 939 |
| CCUCCGCCUGAAGUCUCCAU | 940 |
| AGAAGGAGACAAGGCCACUU | 941 |
| UAGAAGGAGACAAGGCCACU | 942 |
| UCCCGGUAGAAGGAGACAAG | 943 |
| GUCCCGGUAGAAGGAGACAA | 944 |
| AGUCCCGGUAGAAGGAGACA | 945 |

TABLE 1-continued

| Sequence | SEQ ID NO: |
|---|---|
| CAGUCCCGGUAGAAGGAGAC | 946 |
| CCAGUCCCGGUAGAAGGAGA | 947 |
| UCCAGUCCCGGUAGAAGGAG | 948 |
| UUCCAGUCCCGGUAGAAGGA | 949 |
| UGCUUCCAGUCCCGGUAGAA | 950 |
| CUGCUUCCAGUCCCGGUAGA | 951 |
| CCUGCUUGUACUGCUUCCAG | 952 |
| CCCUGCUUGUACUGCUUCCA | 953 |
| GAUGCUGCCAAAGCCCUGCU | 954 |
| ACGGAUGCUGCCAAAGCCCU | 955 |
| CGGUGGAUGUGUUCGUUCCC | 956 |
| CCGGUGGAUGUGUUCGUUCC | 957 |
| GCCGGUGGAUGUGUUCGUUC | 958 |
| AGCCGGUGGAUGUGUUCGUU | 959 |
| GAGCCGGUGGAUGUGUUCGU | 960 |
| AGAGCCGGUGGAUGUGUUCG | 961 |
| GAGAGCCGGUGGAUGUGUUC | 962 |
| GGAGAGCCGGUGGAUGUGUU | 963 |
| UGGAGAGCCGGUGGAUGUGU | 964 |
| UCUGGAGAGCCGGUGGAUGU | 965 |
| UGUCUGGAGAGCCGGUGGAU | 966 |
| UGUGCUUACCUCCAUCUCUA | 967 |
| UUGUGCUUACCUCCAUCUCU | 968 |
| CCGGAGUUGUACGCGGUCAU | 969 |
| UCAGAAUAGGAAUGGCACCC | 970 |
| AUCAGAAUAGGAAUGGCACC | 971 |
| AAUCAGAAUAGGAAUGGCAC | 972 |
| GAAUCAGAAUAGGAAUGGCA | 973 |
| GCAGGAAAACCAUCACAAUG | 974 |
| UGCAGGAAAACCAUCACAAU | 975 |
| UUGCAGGAAAACCAUCACAA | 976 |
| UUACAACUUGCAGGAAAACC | 977 |
| CUCCAUUACAACUUGCAGGA | 978 |
| ACUCCAUUACAACUUGCAGG | 979 |
| AACUCCAUUACAACUUGCAG | 980 |
| CAACUCCAUUACAACUUGCA | 981 |
| CCUCAACUCCAUUACAACUU | 982 |
| UCCUCAACUCCAUUACAACU | 983 |
| UUCCUCAACUCCAUUACAAC | 984 |
| UCUACUCUGGCCUGGGUCUG | 985 |
| UGAAUUUGCUCUACUCUGGC | 986 |
| UUGAAUUUGCUCUACUCUGG | 987 |
| GUUGAAUUUGCUCUACUCUG | 988 |
| UCGGCCAGAGCAGAGACUAG | 989 |
| CUCGGCCAGAGCAGAGACUA | 990 |
| AAGGACCUCAUGCUCGGCCA | 991 |
| AAAGGACCUCAUGCUCGGCC | 992 |
| UAAAGGACCUCAUGCUCGGC | 993 |
| CUAAAGGACCUCAUGCUCGG | 994 |
| CCUAAAGGACCUCAUGCUCG | 995 |
| ACCUAAAGGACCUCAUGCUC | 996 |
| CACCUAAAGGACCUCAUGCU | 997 |
| GCACCUAAAGGACCUCAUGC | 998 |
| UGCACCUAAAGGACCUCAUG | 999 |
| UUGCACCUAAAGGACCUCAU | 1000 |
| AUUUGCACCUAAAGGACCUC | 1001 |
| GAUUUGCACCUAAAGGACCU | 1002 |
| AGAUUUGCACCUAAAGGACC | 1003 |
| AAGAUUUGCACCUAAAGGAC | 1004 |
| GUAAGAUUUGCACCUAAAGG | 1005 |
| GUGAGUGCUUUCAGACCUUC | 1006 |
| AGUGAGUGCUUUCAGACCUU | 1007 |
| UAGUGAGUGCUUUCAGACCU | 1008 |
| UAUAGUGAGUGCUUUCAGAC | 1009 |
| GAUAUAGUGAGUGCUUUCAG | 1010 |
| AGGAUAUAGUGAGUGCUUUC | 1011 |
| GAGGAUAUAGUGAGUGCUUU | 1012 |
| AGAGCUGCUGUAAGAGAAAC | 1013 |
| CAGAGCUGCUGUAAGAGAAA | 1014 |
| GAAUCCCACACAGAGCUGCU | 1015 |
| CUAUAUUCCUCACUUUCCUG | 1016 |
| GGCCUUGAUUAGUCUCUCUU | 1017 |
| UGGCCUUGAUUAGUCUCUCU | 1018 |
| AUGGCCUUGAUUAGUCUCUC | 1019 |
| UAUGGCCUUGAUUAGUCUCU | 1020 |
| AUAUGGCCUUGAUUAGUCUC | 1021 |
| GAACUUCUUUCCUGAUUCAC | 1022 |
| UCGAACUUCUUUCCUGAUUC | 1023 |

TABLE 1-continued

| Sequence | SEQ ID NO: |
|---|---|
| CUCGAACUUCUUUCCUGAUU | 1024 |
| GCUCGAACUUCUUUCCUGAU | 1025 |
| GGCUCGAACUUCUUUCCUGA | 1026 |
| AGGCUCGAACUUCUUUCCUG | 1027 |
| AAGGCUCGAACUUCUUUCCU | 1028 |
| CAAGGCUCGAACUUCUUUCC | 1029 |
| ACAAGGCUCGAACUUCUUUC | 1030 |
| AACAAGGCUCGAACUUCUUU | 1031 |
| AAACAAGGCUCGAACUUCUU | 1032 |
| AAAACAAGGCUCGAACUUCU | 1033 |
| GAAAACAAGGCUCGAACUUC | 1034 |
| AGAAAACAAGGCUCGAACUU | 1035 |
| AAUCAGAAAACAAGGCUCGA | 1036 |
| CCUGGGAAUCAGAAAACAAG | 1037 |
| ACCUCCAGUUUACUGUGUUA | 1038 |
| UUACCUCCAGUUUACUGUGU | 1039 |
| GUUUACCUCCAGUUUACUGU | 1040 |
| UGUUUACCUCCAGUUUACUG | 1041 |
| CUUGUUUACCUCCAGUUUAC | 1042 |
| AGUCCCAUAGCCAAACAUCU | 1043 |
| CAGUCCCAUAGCCAAACAUC | 1044 |
| ACAGUCCCAUAGCCAAACAU | 1045 |
| GACAGUCCCAUAGCCAAACA | 1046 |
| UGACAGUCCCAUAGCCAAAC | 1047 |
| CUGACAGUCCCAUAGCCAAA | 1048 |
| CCUGACAGUCCCAUAGCCAA | 1049 |
| UCUCCUGACAGUCCCAUAGC | 1050 |
| CUCUCCUGACAGUCCCAUAG | 1051 |
| UCUCUCCUGACAGUCCCAUA | 1052 |
| CCUUCUCUCCUGACAGUCCC | 1053 |
| GGCUCCAUUUCAUGCUGUCU | 1054 |
| AGGCUCCAUUUCAUGCUGUC | 1055 |
| GCAGGCUCCAUUUCAUGCUG | 1056 |
| GCAGCAGGCUCCAUUUCAUG | 1057 |
| AAGUGCAGCAGGCUCCAUUU | 1058 |
| AAAGUGCAGCAGGCUCCAUU | 1059 |
| GAAAGUGCAGCAGGCUCCAU | 1060 |
| AGAAAGUGCAGCAGGCUCCA | 1061 |
| AAGAAAGUGCAGCAGGCUCC | 1062 |
| UAAAGAAAGUGCAGCAGGCU | 1063 |
| UUAAAGAAAGUGCAGCAGGC | 1064 |
| CUUAAAGAAAGUGCAGCAGG | 1065 |
| GCCUUAAAGAAAGUGCAGCA | 1066 |
| AGCCUUAAAGAAAGUGCAGC | 1067 |
| AGCAGAGCCUUAAAGAAAGU | 1068 |
| GAGCAGAGCCUUAAAGAAAG | 1069 |
| AGGAGCAGAGCCUUAAAGAA | 1070 |
| GAGGAGCAGAGCCUUAAAGA | 1071 |
| AGGAGGAGCAGAGCCUUAAA | 1072 |
| UCAGGAGGAGCAGAGCCUUA | 1073 |
| UUGCCCUCCCAGUCCUGUCA | 1074 |
| ACUCAGCGUAGCGCAGGUUG | 1075 |
| UACUCAGCGUAGCGCAGGUU | 1076 |
| UAUACUCAGCGUAGCGCAGG | 1077 |
| CUAUACUCAGCGUAGCGCAG | 1078 |
| ACAAAGUGGCUAUACUCAGC | 1079 |
| AACAAAGUGGCUAUACUCAG | 1080 |
| CAUUGCCCAAAACAAAGUGG | 1081 |
| GUUGAGUUCAUUGCCCAAAA | 1082 |
| UGUUGAGUUCAUUGCCCAAA | 1083 |
| CUGUUGAGUUCAUUGCCCAA | 1084 |
| GCUGUUGAGUUCAUUGCCCA | 1085 |
| CGAUAGCUGUUGAGUUCAUU | 1086 |
| GGCGAUAGCUGUUGAGUUCA | 1087 |
| AGGCGAUAGCUGUUGAGUUC | 1088 |
| GAGGCGAUAGCUGUUGAGUU | 1089 |
| AGAGGCGAUAGCUGUUGAGU | 1090 |
| AAGAGGCGAUAGCUGUUGAG | 1091 |
| GAAGAGGCGAUAGCUGUUGA | 1092 |
| GGAAGAGGCGAUAGCUGUUG | 1093 |
| AGGAAGAGGCGAUAGCUGUU | 1094 |
| CAGGAAGAGGCGAUAGCUGU | 1095 |
| CCAGGAAGAGGCGAUAGCUG | 1096 |
| CCCAGGAAGAGGCGAUAGCU | 1097 |
| ACAUUGCCAGUGUAGUUCCC | 1098 |
| CACAUUGCCAGUGUAGUUCC | 1099 |
| CCACAUUGCCAGUGUAGUUC | 1100 |
| CCCACAUUGCCAGUGUAGUU | 1101 |

TABLE 1-continued

| Sequence | SEQ ID NO: |
|---|---|
| AUACUGGAGGGCGUCGUUCC | 1102 |
| GAUACUGGAGGGCGUCGUUC | 1103 |
| UGAUACUGGAGGGCGUCGUU | 1104 |
| AUGAUACUGGAGGGCGUCGU | 1105 |
| UAUGAUACUGGAGGGCGUCG | 1106 |
| UUGUUAUGAUACUGGAGGGC | 1107 |
| GUUGUUAUGAUACUGGAGGG | 1108 |
| UGUUGUUAUGAUACUGGAGG | 1109 |
| CUGUGUUGUUAUGAUACUGG | 1110 |
| GCUGUGUUGUUAUGAUACUG | 1111 |
| GGCUGUGUUGUUAUGAUACU | 1112 |
| AGGCUGUGUUGUUAUGAUAC | 1113 |
| GAAGGCUGUGUUGUUAUGAU | 1114 |
| UGAAGGCUGUGUUGUUAUGA | 1115 |
| CUGAAGGCUGUGUUGUUAUG | 1116 |
| GCUGAAGGCUGUGUUGUUAU | 1117 |
| UGCUGAAGGCUGUGUUGUUA | 1118 |
| UGUCCUUGUCCUUGGUGCUG | 1119 |
| UUGUCCUUGUCCUUGGUGCU | 1120 |
| GCAGUUGUCAUUGUCCUUGU | 1121 |
| CCAAGCAGUUGUCAUUGUCC | 1122 |
| UCCAAGCAGUUGUCAUUGUC | 1123 |
| UGUCCAAGCAGUUGUCAUUG | 1124 |
| UUGUCCAAGCAGUUGUCAUU | 1125 |
| CUUGUCCAAGCAGUUGUCAU | 1126 |
| ACUUGUCCAAGCAGUUGUCA | 1127 |
| CACUUGUCCAAGCAGUUGUC | 1128 |
| ACACUUGUCCAAGCAGUUGU | 1129 |
| CACACUUGUCCAAGCAGUUG | 1130 |
| GCACACUUGUCCAAGCAGUU | 1131 |
| UGCACACUUGUCCAAGCAGU | 1132 |
| CACCUUUGCGGAGCUGUGCA | 1133 |
| UCACCUUUGCGGAGCUGUGC | 1134 |
| CUCACCUUUGCGGAGCUGUG | 1135 |
| UCUCACCUUUGCGGAGCUGU | 1136 |
| AUCUCACCUUUGCGGAGCUG | 1137 |
| AAUCUCACCUUUGCGGAGCU | 1138 |
| AAAUCUCACCUUUGCGGAGC | 1139 |
| AGCUUGUACCUGAACUUCUC | 1140 |
| GAGCUUGUACCUGAACUUCU | 1141 |
| UGAGCUUGUACCUGAACUUC | 1142 |
| UAUGAGCUUGUACCUGAACU | 1143 |
| UUAUGAGCUUGUACCUGAAC | 1144 |
| GGAUUAUGAGCUUGUACCUG | 1145 |
| GGGAUUAUGAGCUUGUACCU | 1146 |
| UGGGAUUAUGAGCUUGUACC | 1147 |
| GUGGGAUUAUGAGCUUGUAC | 1148 |
| AGUGGGAUUAUGAGCUUGUA | 1149 |
| UCAAGUGGGAUUAUGAGCUU | 1150 |
| CUCUUUCUCCUCAAGUGGGA | 1151 |
| AACCGGAAUAUCAACUGUAC | 1152 |
| CAAAACCGGAAUAUCAACUG | 1153 |
| CCAAAACCGGAAUAUCAACU | 1154 |
| ACCAAAACCGGAAUAUCAAC | 1155 |
| GAAAGAAUACCAAAACCGGA | 1156 |
| GGGUCAGAAAGAAUACCAAA | 1157 |
| AGGGUCAGAAAGAAUACCAA | 1158 |
| ACCAGACAUCAGGUAAGGAG | 1159 |
| GACCAGACAUCAGGUAAGGA | 1160 |
| AGACCAGACAUCAGGUAAGG | 1161 |
| AUAGACCAGACAUCAGGUAA | 1162 |
| GAUAGACCAGACAUCAGGUA | 1163 |
| ACUGUGAUAGACCAGACAUC | 1164 |
| GACUGUGAUAGACCAGACAU | 1165 |
| UGACUGUGAUAGACCAGACA | 1166 |
| UUGACUGUGAUAGACCAGAC | 1167 |
| GUUGACUGUGAUAGACCAGA | 1168 |
| AGUUGACUGUGAUAGACCAG | 1169 |
| AAGUUGACUGUGAUAGACCA | 1170 |
| GCUAGUAAGUUGACUGUGAU | 1171 |
| UGCUAGUAAGUUGACUGUGA | 1172 |
| GUGCUAGUAAGUUGACUGUG | 1173 |
| AGUGCUAGUAAGUUGACUGU | 1174 |
| GACCCAGUGCUAGUAAGUUG | 1175 |
| AGACCCAGUGCUAGUAAGUU | 1176 |
| CAGACCCAGUGCUAGUAAGU | 1177 |
| ACAGACCCAGUGCUAGUAAG | 1178 |
| AACAGACCCAGUGCUAGUAA | 1179 |

TABLE 1-continued

| Sequence | SEQ ID NO: |
|---|---|
| AAACAGACCCAGUGCUAGUA | 1180 |
| GAAACAGACCCAGUGCUAGU | 1181 |
| CAUGAGAAACAGACCCAGUG | 1182 |
| GCCACCUGGCAUGAGAAACA | 1183 |
| AGCCACCUGGCAUGAGAAAC | 1184 |
| UAGCCACCUGGCAUGAGAAA | 1185 |
| AGUAGCCACCUGGCAUGAGA | 1186 |
| CAGUAGCCACCUGGCAUGAG | 1187 |
| GUUGUACCAGUAGCCACCUG | 1188 |
| AGUUGUACCAGUAGCCACCU | 1189 |
| CAGCAGUUGUACCAGUAGCC | 1190 |
| GCAGCAGUUGUACCAGUAGC | 1191 |
| GUGCAGCAGUUGUACCAGUA | 1192 |
| UGUGCAGCAGUUGUACCAGU | 1193 |
| CUGUGCAGCAGUUGUACCAG | 1194 |
| UCUGUGCAGCAGUUGUACCA | 1195 |
| GUCUGUGCAGCAGUUGUACC | 1196 |
| AGUCUGUGCAGCAGUUGUAC | 1197 |
| GAGUCUGUGCAGCAGUUGUA | 1198 |
| GGAGUCUGUGCAGCAGUUGU | 1199 |
| UUGGAGUCUGUGCAGCAGUU | 1200 |
| GUUGGAGUCUGUGCAGCAGU | 1201 |
| GAGGUUGGAGUCUGUGCAGC | 1202 |
| AUUGAGGUUGGAGUCUGUGC | 1203 |
| CAUUGAGGUUGGAGUCUGUG | 1204 |
| CCAUUGAGGUUGGAGUCUGU | 1205 |
| GUACACUCCAUUGAGGUUGG | 1206 |
| UAGUACACUCCAUUGAGGUU | 1207 |
| GGUAGUACACUCCAUUGAGG | 1208 |
| CGGUAGUACACUCCAUUGAG | 1209 |
| GCGGUAGUACACUCCAUUGA | 1210 |
| GGCGGUAGUACACUCCAUUG | 1211 |
| AGGCGGUAGUACACUCCAUU | 1212 |
| CAGGCGGUAGUACACUCCAU | 1213 |
| CCAGGCGGUAGUACACUCCA | 1214 |
| CUCACCCAGGCGGUAGUACA | 1215 |
| UGCUCACCCAGGCGGUAGUA | 1216 |
| GCUUAUUGUGCUCACCCAGG | 1217 |
| UGCUUAUUGUGCUCACCCAG | 1218 |

TABLE 1-continued

| Sequence | SEQ ID NO: |
|---|---|
| GUGCUUAUUGUGCUCACCCA | 1219 |
| CCAGGUGCUUAUUGUGCUCA | 1220 |
| UCCAGGUGCUUAUUGUGCUC | 1221 |
| CCAUCCAGGUGCUUAUUGUG | 1222 |
| GCCAUCCAGGUGCUUAUUGU | 1223 |
| UGCCAUCCAGGUGCUUAUUG | 1224 |
| AUGCCAUCCAGGUGCUUAUU | 1225 |
| GAUGCCAUCCAGGUGCUUAU | 1226 |
| UGAUGCCAUCCAGGUGCUUA | 1227 |
| ACCAGGUGAUGCCAUCCAGG | 1228 |
| UACCAGGUGAUGCCAUCCAG | 1229 |
| UAGGUAGAUCCAUGCCAGCC | 1230 |
| GUAGGUAGAUCCAUGCCAGC | 1231 |
| GAGUAGGUAGAUCCAUGCCA | 1232 |
| GGAGUAGGUAGAUCCAUGCC | 1233 |
| GGGAGUAGGUAGAUCCAUGC | 1234 |
| AGGGAGUAGGUAGAUCCAUG | 1235 |
| GAGGGAGUAGGUAGAUCCAU | 1236 |
| UGAGGGAGUAGGUAGAUCCA | 1237 |
| UUGAGGGAGUAGGUAGAUCC | 1238 |
| UUUGAGGGAGUAGGUAGAUC | 1239 |
| CGUUUGAGGGAGUAGGUAGA | 1240 |
| CCGUUUGAGGGAGUAGGUAG | 1241 |
| CCCGUUUGAGGGAGUAGGUA | 1242 |
| ACCCGUUUGAGGGAGUAGGU | 1243 |
| CACCCGUUUGAGGGAGUAGG | 1244 |
| CCACCCGUUUGAGGGAGUAG | 1245 |
| UCCACCCGUUUGAGGGAGUA | 1246 |
| AUCUCCACCCGUUUGAGGGA | 1247 |
| CAUCUCCACCCGUUUGAGGG | 1248 |
| UCAUCUCCACCCGUUUGAGG | 1249 |
| UUCAUCUCCACCCGUUUGAG | 1250 |
| UUUCAUCUCCACCCGUUUGA | 1251 |
| UUUUCAUCUCCACCCGUUUG | 1252 |
| AUUUUCAUCUCCACCCGUUU | 1253 |
| GGCGGAUUUUCAUCUCCACC | 1254 |
| GGCUUGAAGUCUUCGGGCG | 1255 |
| AAGGCUUGAAGUCUUCUGGG | 1256 |
| CCUUUUAAGGCUUGAAGUCU | 1257 |

TABLE 1-continued

| Sequence | SEQ ID NO: |
|---|---|
| CUCCUUUUAAGGCUUGAAGU | 1258 |
| CCUCCUUUUAAGGCUUGAAG | 1259 |
| ACGGCAGCCUCCUUUUAAGG | 1260 |
| CACGGCAGCCUCCUUUUAAG | 1261 |
| CUCCACGGCAGCCUCCUUUU | 1262 |
| UUUCUGUAUCCGUGCUCCAC | 1263 |
| AGUUUCUGUAUCCGUGCUCC | 1264 |
| CAGUUUCUGUAUCCGUGCUC | 1265 |
| CUCAGUUUCUGUAUCCGUGC | 1266 |
| UGUCUCAGUUUCUGUAUCCG | 1267 |
| UGCCCUCAUCCAGUCUCCAC | 1268 |
| AUCUGCCCUCAUCCAGUCUC | 1269 |
| CAUCUGCCCUCAUCCAGUCU | 1270 |
| UCAUCUGCCCUCAUCCAGUC | 1271 |
| CCUCAUCUGCCCUCAUCCAG | 1272 |
| CUAACACUCUCUUCCUGUCC | 1273 |
| UCUAACACUCUCUUCCUGUC | 1274 |
| UUCUAACACUCUCUUCCUGU | 1275 |
| UAUAGGCUGUUUCUCAGUCC | 1276 |
| CCUUGGAGACUUAUUCUUUC | 1277 |
| GCUCCUUGGAGACUUAUUCU | 1278 |
| UGCUCCUUGGAGACUUAUUC | 1279 |
| UUUUGUGCUCCUUGGAGACU | 1280 |
| UACUGUAACAUCCUUGGUAC | 1281 |
| GUUUACUGUAACAUCCUUGG | 1282 |
| AGGAUGUGGCAGGACCCAGU | 1283 |
| AAGGAUGUGGCAGGACCCAG | 1284 |
| GAAGGAUGUGGCAGGACCCA | 1285 |
| UGAGAAGGAUGUGGCAGGAC | 1286 |
| CAGUCUACCACCUUGAGAAG | 1287 |
| CACUCAGUCUACCACCUUGA | 1288 |
| GGAUCUUGGGCAGAGAGACC | 1289 |
| GGGAUCUUGGGCAGAGAGAC | 1290 |
| AGGGAUCUUGGGCAGAGAGA | 1291 |
| CAGGGAUCUUGGGCAGAGAG | 1292 |
| UGUCAGGGAUCUUGGGCAGA | 1293 |
| AUGUCAGGGAUCUUGGGCAG | 1294 |
| UAUGUCAGGGAUCUUGGGCA | 1295 |
| CUAUGUCAGGGAUCUUGGGC | 1296 |

TABLE 1-continued

| Sequence | SEQ ID NO: |
|---|---|
| GCUAUGUCAGGGAUCUUGGG | 1297 |
| UGCUAUGUCAGGGAUCUUGG | 1298 |
| CUGCUAUGUCAGGGAUCUUG | 1299 |
| AGCUACUGCUAUGUCAGGGA | 1300 |
| AAGCUACUGCUAUGUCAGGG | 1301 |
| AAGACAAGCUACUGCUAUGU | 1302 |
| CAUGUGGAAAAGACAAGCUA | 1303 |
| AUCAUGUGGAAAAGACAAGC | 1304 |
| GCCCUCACAUAGCCUAAGCC | 1305 |
| UUGCCCUCACAUAGCCUAAG | 1306 |
| UUUGCCCUCACAUAGCCUAA | 1307 |
| UUUUGCCCUCACAUAGCCUA | 1308 |
| GUUUUGCCCUCACAUAGCCU | 1309 |
| UGUUUUGCCCUCACAUAGCC | 1310 |
| GUGUUUUGCCCUCACAUAGC | 1311 |
| GAUUUGUGUUUUGCCCUCAC | 1312 |
| GGAUUUGUGUUUUGCCCUCA | 1313 |
| AAGGGAUUUGUGUUUUGCCC | 1314 |
| ACUCCUUUCUCUAACACUCA | 1315 |
| CACCUGCCUCCUUCACUCCU | 1316 |
| UACCAUUUCCCACCUGCCUC | 1317 |
| AUACCAUUUCCCACCUGCCU | 1318 |
| UCCAGCCUGGGUCAGUUCCA | 1319 |
| UGCAGUGCCCUGGAGUUUCC | 1320 |
| GAUGCAGUGCCCUGGAGUUU | 1321 |
| CAGAUGCAGUGCCCUGGAGU | 1322 |
| UGAUCGCCAGAUGCAGUGCC | 1323 |
| CUGAUCGCCAGAUGCAGUGC | 1324 |
| ACAUGACCAAGGCGAGCAGG | 1325 |
| UACAUGACCAAGGCGAGCAG | 1326 |
| GCUGGUGCUUCAUUCCUUUC | 1327 |
| CUGCUGGUGCUUCAUUCCUU | 1328 |
| CCUGCUGGUGCUUCAUUCCU | 1329 |
| ACUCUGUCCACCUCCUGCUG | 1330 |
| AGAGACUCUGUCCACCUCCU | 1331 |
| AUGAGAGACUCUGUCCACCU | 1332 |
| CAUCCAUGAGAGACUCUGUC | 1333 |
| GCAUCCAUGAGAGACUCUGU | 1334 |
| GGCAUCCAUGAGAGACUCUG | 1335 |

TABLE 1-continued

| Sequence | SEQ ID NO: |
|---|---|
| CCUUGAGCUUGUUUCUUACA | 1336 |
| UUCAACCAUUUCCUACAGAC | 1337 |
| CCAUCUACCUUCAGUUUUCA | 1338 |
| ACACCAUCUACCUUCAGUUU | 1339 |
| AACACCAUCUACCUUCAGUU | 1340 |
| UAACACCAUCUACCUUCAGU | 1341 |

TABLE 2

| Sequence | SEQ ID NO: |
|---|---|
| AGAAGGAGACAAGGCCACUU | 1342 |
| UAGAAGGAGACAAGGCCACU | 1343 |
| UCCCGGUAGAAGGAGACAAG | 1344 |
| GUCCCGGUAGAAGGAGACAA | 1345 |
| AGUCCCGGUAGAAGGAGACA | 1346 |
| CAGUCCCGGUAGAAGGAGAC | 1347 |
| CCAGUCCCGGUAGAAGGAGA | 1348 |
| UCCAGUCCCGGUAGAAGGAG | 1349 |
| UUCCAGUCCCGGUAGAAGGA | 1350 |
| UGCUUCCAGUCCCGGUAGAA | 1351 |
| CUGCUUCCAGUCCCGGUAGA | 1352 |
| CCUGCUUGUACUGCUUCCAG | 1353 |
| CCCUGCUUGUACUGCUUCCA | 1354 |
| GAUGCUGCCAAAGCCCUGCU | 1355 |
| ACGGAUGCUGCCAAAGCCCU | 1356 |
| CGGUGGAUGUGUUCGUUCCC | 1357 |
| CCGGUGGAUGUGUUCGUUCC | 1358 |
| GCCGGUGGAUGUGUUCGUUC | 1359 |
| AGCCGGUGGAUGUGUUCGUU | 1360 |
| GAGCCGGUGGAUGUGUUCGU | 1361 |
| AGAGCCGGUGGAUGUGUUCG | 1362 |
| GAGAGCCGGUGGAUGUGUUC | 1363 |
| GGAGAGCCGGUGGAUGUGUU | 1364 |
| UGGAGAGCCGGUGGAUGUGU | 1365 |
| UCUGGAGAGCCGGUGGAUGU | 1366 |
| UGUCUGGAGAGCCGGUGGAU | 1367 |
| UGUGCUUACCUCCAUCUCUA | 1368 |
| UUGUGCUUACCUCCAUCUCU | 1369 |
| CCGGAGUUGUACGCGGUCAU | 1370 |
| UCAGAAUAGGAAUGGCACCC | 1371 |

TABLE 2-continued

| Sequence | SEQ ID NO: |
|---|---|
| AUCAGAAUAGGAAUGGCACC | 1372 |
| AAUCAGAAUAGGAAUGGCAC | 1373 |
| GAAUCAGAAUAGGAAUGGCA | 1374 |
| GCAGGAAAACCAUCACAAUG | 1375 |
| UGCAGGAAAACCAUCACAAU | 1376 |
| UUGCAGGAAAACCAUCACAA | 1377 |
| UUACAACUUGCAGGAAAACC | 1378 |
| CUCCAUUACAACUUGCAGGA | 1379 |
| ACUCCAUUACAACUUGCAGG | 1380 |
| AACUCCAUUACAACUUGCAG | 1381 |
| CAACUCCAUUACAACUUGCA | 1382 |
| CCUCAACUCCAUUACAACUU | 1383 |
| UCCUCAACUCCAUUACAACU | 1384 |
| UUCCUCAACUCCAUUACAAC | 1385 |
| UCUACUCUGGCCUGGGUCUG | 1386 |
| UGAAUUUGCUCUACUCUGGC | 1387 |
| UUGAAUUUGCUCUACUCUGG | 1388 |
| GUUGAAUUUGCUCUACUCUG | 1389 |
| UCGGCCAGAGCAGAGACUAG | 1390 |
| CUCGGCCAGAGCAGAGACUA | 1391 |
| AAGGACCUCAUGCUCGGCCA | 1392 |
| AAAGGACCUCAUGCUCGGCC | 1393 |
| UAAAGGACCUCAUGCUCGGC | 1394 |
| CUAAAGGACCUCAUGCUCGG | 1395 |
| CCUAAAGGACCUCAUGCUCG | 1396 |
| ACCUAAAGGACCUCAUGCUC | 1397 |
| CACCUAAAGGACCUCAUGCU | 1398 |
| GCACCUAAAGGACCUCAUGC | 1399 |
| UGCACCUAAAGGACCUCAUG | 1400 |
| UUGCACCUAAAGGACCUCAU | 1401 |
| AUUUGCACCUAAAGGACCUC | 1402 |
| GAUUUGCACCUAAAGGACCU | 1403 |
| AGAUUUGCACCUAAAGGACC | 1404 |
| AAGAUUUGCACCUAAAGGAC | 1405 |
| GUAAGAUUUGCACCUAAAGG | 1406 |
| GUGAGUGCUUUCAGACCUUC | 1407 |
| AGUGAGUGCUUUCAGACCUU | 1408 |
| UAGUGAGUGCUUUCAGACCU | 1409 |
| UAUAGUGAGUGCUUUCAGAC | 1410 |

TABLE 2-continued

| Sequence | SEQ ID NO: |
|---|---|
| GAUAUAGUGAGUGCUUUCAG | 1411 |
| AGGAUAUAGUGAGUGCUUUC | 1412 |
| GAGGAUAUAGUGAGUGCUUU | 1413 |
| AGAGCUGCUGUAAGAGAAAC | 1414 |
| CAGAGCUGCUGUAAGAGAAA | 1415 |
| GAAUCCCACACAGAGCUGCU | 1416 |
| CUAUAUUCCUCACUUUCCUG | 1417 |
| GGCCUUGAUUAGUCUCUCUU | 1418 |
| UGGCCUUGAUUAGUCUCUCU | 1419 |
| AUGGCCUUGAUUAGUCUCUC | 1420 |
| UAUGGCCUUGAUUAGUCUCU | 1421 |
| AUAUGGCCUUGAUUAGUCUC | 1422 |
| GAACUUCUUUCCUGAUUCAC | 1423 |
| UCGAACUUCUUUCCUGAUUC | 1424 |
| CUCGAACUUCUUUCCUGAUU | 1425 |
| GCUCGAACUUCUUUCCUGAU | 1426 |
| GGCUCGAACUUCUUUCCUGA | 1427 |
| AGGCUCGAACUUCUUUCCUG | 1428 |
| AAGGCUCGAACUUCUUUCCU | 1429 |
| CAAGGCUCGAACUUCUUUCC | 1430 |
| ACAAGGCUCGAACUUCUUUC | 1431 |
| AACAAGGCUCGAACUUCUUU | 1432 |
| AAACAAGGCUCGAACUUCUU | 1433 |
| AAAACAAGGCUCGAACUUCU | 1434 |
| GAAAACAAGGCUCGAACUUC | 1435 |
| AGAAAACAAGGCUCGAACUU | 1436 |
| AAUCAGAAAACAAGGCUCGA | 1437 |
| CCUGGGAAUCAGAAAACAAG | 1438 |
| ACCUCCAGUUUACUGUGUUA | 1439 |
| UUACCUCCAGUUUACUGUGU | 1440 |
| GUUUACCUCCAGUUUACUGU | 1441 |
| UGUUUACCUCCAGUUUACUG | 1442 |
| CUUGUUUACCUCCAGUUUAC | 1443 |
| AGUCCCAUAGCCAAACAUCU | 1444 |
| CAGUCCCAUAGCCAAACAUC | 1445 |
| ACAGUCCCAUAGCCAAACAU | 1446 |
| GACAGUCCCAUAGCCAAACA | 1447 |
| UGACAGUCCCAUAGCCAAAC | 1448 |
| CUGACAGUCCCAUAGCCAAA | 1449 |
| CCUGACAGUCCCAUAGCCAA | 1450 |
| UCUCCUGACAGUCCCAUAGC | 1451 |
| CUCUCCUGACAGUCCCAUAG | 1452 |
| UCUCUCCUGACAGUCCCAUA | 1453 |
| CCUUCUCUCCUGACAGUCCC | 1454 |
| GGCUCCAUUUCAUGCUGUCU | 1455 |
| AGGCUCCAUUUCAUGCUGUC | 1456 |
| GCAGGCUCCAUUUCAUGCUG | 1457 |
| GCAGCAGGCUCCAUUUCAUG | 1458 |
| AAGUGCAGCAGGCUCCAUUU | 1459 |
| AAAGUGCAGCAGGCUCCAUU | 1460 |
| GAAAGUGCAGCAGGCUCCAU | 1461 |
| AGAAAGUGCAGCAGGCUCCA | 1462 |
| AAGAAAGUGCAGCAGGCUCC | 1463 |
| UAAAGAAAGUGCAGCAGGCU | 1464 |
| UUAAAGAAAGUGCAGCAGGC | 1465 |
| CUUAAAGAAAGUGCAGCAGG | 1466 |
| GCCUUAAAGAAAGUGCAGCA | 1467 |
| AGCCUUAAAGAAAGUGCAGC | 1468 |
| AGCAGAGCCUUAAAGAAAGU | 1469 |
| GAGCAGAGCCUUAAAGAAAG | 1470 |
| AGGAGCAGAGCCUUAAAGAA | 1471 |
| GAGGAGCAGAGCCUUAAAGA | 1472 |
| AGGAGGAGCAGAGCCUUAAA | 1473 |
| UCAGGAGGAGCAGAGCCUUA | 1474 |
| UUGCCCUCCCAGUCCUGUCA | 1475 |
| ACUCAGCGUAGCGCAGGUUG | 1476 |
| UACUCAGCGUAGCGCAGGUU | 1477 |
| UAUACUCAGCGUAGCGCAGG | 1478 |
| CUAUACUCAGCGUAGCGCAG | 1479 |
| ACAAAGUGGCUAUACUCAGC | 1480 |
| AACAAAGUGGCUAUACUCAG | 1481 |
| CAUUGCCCAAAACAAAGUGG | 1482 |
| GUUGAGUUCAUUGCCCAAAA | 1483 |
| UGUUGAGUUCAUUGCCCAAA | 1484 |
| CUGUUGAGUUCAUUGCCCAA | 1485 |
| GCUGUUGAGUUCAUUGCCCA | 1486 |
| CGAUAGCUGUUGAGUUCAUU | 1487 |
| GGCGAUAGCUGUUGAGUUCA | 1488 |

TABLE 2-continued

| Sequence | SEQ ID NO: |
| --- | --- |
| AGGCGAUAGCUGUUGAGUUC | 1489 |
| GAGGCGAUAGCUGUUGAGUU | 1490 |
| AGAGGCGAUAGCUGUUGAGU | 1491 |
| AAGAGGCGAUAGCUGUUGAG | 1492 |
| GAAGAGGCGAUAGCUGUUGA | 1493 |
| GGAAGAGGCGAUAGCUGUUG | 1494 |
| AGGAAGAGGCGAUAGCUGUU | 1495 |
| CAGGAAGAGGCGAUAGCUGU | 1496 |
| CCAGGAAGAGGCGAUAGCUG | 1497 |
| CCCAGGAAGAGGCGAUAGCU | 1498 |
| ACAUUGCCAGUGUAGUUCCC | 1499 |
| CACAUUGCCAGUGUAGUUCC | 1500 |
| CCACAUUGCCAGUGUAGUUC | 1501 |
| CCCACAUUGCCAGUGUAGUU | 1502 |
| AUACUGGAGGGCGUCGUUCC | 1503 |
| GAUACUGGAGGGCGUCGUUC | 1504 |
| UGAUACUGGAGGGCGUCGUU | 1505 |
| AUGAUACUGGAGGGCGUCGU | 1506 |
| UAUGAUACUGGAGGGCGUCG | 1507 |
| UUGUUAUGAUACUGGAGGGC | 1508 |
| GUUGUUAUGAUACUGGAGGG | 1509 |
| UGUUGUUAUGAUACUGGAGG | 1510 |
| CUGUGUUGUUAUGAUACUGG | 1511 |
| GCUGUGUUGUUAUGAUACUG | 1512 |
| GGCUGUGUUGUUAUGAUACU | 1513 |
| AGGCUGUGUUGUUAUGAUAC | 1514 |
| GAAGGCUGUGUUGUUAUGAU | 1515 |
| UGAAGGCUGUGUUGUUAUGA | 1516 |
| CUGAAGGCUGUGUUGUUAUG | 1517 |
| GCUGAAGGCUGUGUUGUUAU | 1518 |
| UGCUGAAGGCUGUGUUGUUA | 1519 |
| UGUCCUUGUCCUUGGUGCUG | 1520 |
| UUGUCCUUGUCCUUGGUGCU | 1521 |
| GCAGUUGUCAUUGUCCUUGU | 1522 |
| CCAAGCAGUUGUCAUUGUCC | 1523 |
| UCCAAGCAGUUGUCAUUGUC | 1524 |
| UGUCCAAGCAGUUGUCAUUG | 1525 |
| UUGUCCAAGCAGUUGUCAUU | 1526 |
| CUUGUCCAAGCAGUUGUCAU | 1527 |

TABLE 2-continued

| Sequence | SEQ ID NO: |
| --- | --- |
| ACUUGUCCAAGCAGUUGUCA | 1528 |
| CACUUGUCCAAGCAGUUGUC | 1529 |
| ACACUUGUCCAAGCAGUUGU | 1530 |
| CACACUUGUCCAAGCAGUUG | 1531 |
| GCACACUUGUCCAAGCAGUU | 1532 |
| UGCACACUUGUCCAAGCAGU | 1533 |
| CACCUUUGCGGAGCUGUGCA | 1534 |
| UCACCUUUGCGGAGCUGUGC | 1535 |
| CUCACCUUUGCGGAGCUGUG | 1536 |
| UCUCACCUUUGCGGAGCUGU | 1537 |
| AUCUCACCUUUGCGGAGCUG | 1538 |
| AAUCUCACCUUUGCGGAGCU | 1539 |
| AAAUCUCACCUUUGCGGAGC | 1540 |
| AGCUUGUACCUGAACUUCUC | 1541 |
| GAGCUUGUACCUGAACUUCU | 1542 |
| UGAGCUUGUACCUGAACUUC | 1543 |
| UAUGAGCUUGUACCUGAACU | 1544 |
| UUAUGAGCUUGUACCUGAAC | 1545 |
| GGAUUAUGAGCUUGUACCUG | 1546 |
| GGGAUUAUGAGCUUGUACCU | 1547 |
| UGGGAUUAUGAGCUUGUACC | 1548 |
| GUGGGAUUAUGAGCUUGUAC | 1549 |
| AGUGGGAUUAUGAGCUUGUA | 1550 |
| UCAAGUGGGAUUAUGAGCUU | 1551 |
| CUCUUUCUCCUCAAGUGGGA | 1552 |
| AACCGGAAUAUCAACUGUAC | 1553 |
| CAAAACCGGAAUAUCAACUG | 1554 |
| CCAAAACCGGAAUAUCAACU | 1555 |
| ACCAAAACCGGAAUAUCAAC | 1556 |
| GAAAGAAUACCAAAACCGGA | 1557 |
| GGGUCAGAAAGAAUACCAAA | 1558 |
| AGGGUCAGAAAGAAUACCAA | 1559 |
| ACCAGACAUCAGGUAAGGAG | 1560 |
| GACCAGACAUCAGGUAAGGA | 1561 |
| AGACCAGACAUCAGGUAAGG | 1562 |
| AUAGACCAGACAUCAGGUAA | 1563 |
| GAUAGACCAGACAUCAGGUA | 1564 |
| ACUGUGAUAGACCAGACAUC | 1565 |
| GACUGUGAUAGACCAGACAU | 1566 |

TABLE 2-continued

| Sequence | SEQ ID NO: |
|---|---|
| UGACUGUGAUAGACCAGACA | 1567 |
| UUGACUGUGAUAGACCAGAC | 1568 |
| GUUGACUGUGAUAGACCAGA | 1569 |
| AGUUGACUGUGAUAGACCAG | 1570 |
| AAGUUGACUGUGAUAGACCA | 1571 |
| GCUAGUAAGUUGACUGUGAU | 1572 |
| UGCUAGUAAGUUGACUGUGA | 1573 |
| GUGCUAGUAAGUUGACUGUG | 1574 |
| AGUGCUAGUAAGUUGACUGU | 1575 |
| GACCCAGUGCUAGUAAGUUG | 1576 |
| AGACCCAGUGCUAGUAAGUU | 1577 |
| CAGACCCAGUGCUAGUAAGU | 1578 |
| ACAGACCCAGUGCUAGUAAG | 1579 |
| AACAGACCCAGUGCUAGUAA | 1580 |
| AAACAGACCCAGUGCUAGUA | 1581 |
| GAAACAGACCCAGUGCUAGU | 1582 |
| CAUGAGAAACAGACCCAGUG | 1583 |
| GCCACCUGGCAUGAGAAACA | 1584 |
| AGCCACCUGGCAUGAGAAAC | 1585 |
| UAGCCACCUGGCAUGAGAAA | 1586 |
| AGUAGCCACCUGGCAUGAGA | 1587 |
| CAGUAGCCACCUGGCAUGAG | 1588 |
| GUUGUACCAGUAGCCACCUG | 1589 |
| AGUUGUACCAGUAGCCACCU | 1590 |
| CAGCAGUUGUACCAGUAGCC | 1591 |
| GCAGCAGUUGUACCAGUAGC | 1592 |
| GUGCAGCAGUUGUACCAGUA | 1593 |
| UGUGCAGCAGUUGUACCAGU | 1594 |
| CUGUGCAGCAGUUGUACCAG | 1595 |
| UCUGUGCAGCAGUUGUACCA | 1596 |
| GUCUGUGCAGCAGUUGUACC | 1597 |
| AGUCUGUGCAGCAGUUGUAC | 1598 |
| GAGUCUGUGCAGCAGUUGUA | 1599 |
| GGAGUCUGUGCAGCAGUUGU | 1600 |
| UUGGAGUCUGUGCAGCAGUU | 1601 |
| GUUGGAGUCUGUGCAGCAGU | 1602 |
| GAGGUUGGAGUCUGUGCAGC | 1603 |
| AUUGAGGUUGGAGUCUGUGC | 1604 |
| CAUUGAGGUUGGAGUCUGUG | 1605 |
| CCAUUGAGGUUGGAGUCUGU | 1606 |
| GUACACUCCAUUGAGGUUGG | 1607 |
| UAGUACACUCCAUUGAGGUU | 1608 |
| GGUAGUACACUCCAUUGAGG | 1609 |
| CGGUAGUACACUCCAUUGAG | 1610 |
| GCGGUAGUACACUCCAUUGA | 1611 |
| GGCGGUAGUACACUCCAUUG | 1612 |
| AGGCGGUAGUACACUCCAUU | 1613 |
| CAGGCGGUAGUACACUCCAU | 1614 |
| CCAGGCGGUAGUACACUCCA | 1615 |
| CUCACCCAGGCGGUAGUACA | 1616 |
| UGCUCACCCAGGCGGUAGUA | 1617 |
| GCUUAUUGUGCUCACCCAGG | 1618 |
| UGCUUAUUGUGCUCACCCAG | 1619 |
| GUGCUUAUUGUGCUCACCCA | 1620 |
| CCAGGUGCUUAUUGUGCUCA | 1621 |
| UCCAGGUGCUUAUUGUGCUC | 1622 |
| CCAUCCAGGUGCUUAUUGUG | 1623 |
| GCCAUCCAGGUGCUUAUUGU | 1624 |
| UGCCAUCCAGGUGCUUAUUG | 1625 |
| AUGCCAUCCAGGUGCUUAUU | 1626 |
| GAUGCCAUCCAGGUGCUUAU | 1627 |
| UGAUGCCAUCCAGGUGCUUA | 1628 |
| ACCAGGUGAUGCCAUCCAGG | 1629 |
| UACCAGGUGAUGCCAUCCAG | 1630 |
| UAGGUAGAUCCAUGCCAGCC | 1631 |
| GUAGGUAGAUCCAUGCCAGC | 1632 |
| GAGUAGGUAGAUCCAUGCCA | 1633 |
| GGAGUAGGUAGAUCCAUGCC | 1634 |
| GGGAGUAGGUAGAUCCAUGC | 1635 |
| AGGGAGUAGGUAGAUCCAUG | 1636 |
| GAGGGAGUAGGUAGAUCCAU | 1637 |
| UGAGGGAGUAGGUAGAUCCA | 1638 |
| UUGAGGGAGUAGGUAGAUCC | 1639 |
| UUUGAGGGAGUAGGUAGAUC | 1640 |
| CGUUUGAGGGAGUAGGUAGA | 1641 |
| CCGUUUGAGGGAGUAGGUAG | 1642 |
| CCCGUUUGAGGGAGUAGGUA | 1643 |
| ACCCGUUUGAGGGAGUAGGU | 1644 |

TABLE 2-continued

| Sequence | SEQ ID NO: |
|---|---|
| CACCCGUUUGAGGGAGUAGG | 1645 |
| CCACCCGUUUGAGGGAGUAG | 1646 |
| UCCACCCGUUUGAGGGAGUA | 1647 |
| AUCUCCACCCGUUUGAGGGA | 1648 |
| CAUCUCCACCCGUUUGAGGG | 1649 |
| UCAUCUCCACCCGUUUGAGG | 1650 |
| UUCAUCUCCACCCGUUUGAG | 1651 |
| UUUCAUCUCCACCCGUUUGA | 1652 |
| UUUUCAUCUCCACCCGUUUG | 1653 |
| AUUUUCAUCUCCACCCGUUU | 1654 |
| GGCGGAUUUUCAUCUCCACC | 1655 |
| GGCUUGAAGUCUUCUGGGCG | 1656 |
| AAGGCUUGAAGUCUUCUGGG | 1657 |
| CCUUUUAAGGCUUGAAGUCU | 1658 |
| CUCCUUUUAAGGCUUGAAGU | 1659 |
| CCUCCUUUUAAGGCUUGAAG | 1660 |
| ACGGCAGCCUCCUUUUAAGG | 1661 |
| CACGGCAGCCUCCUUUUAAG | 1662 |
| CUCCACGGCAGCCUCCUUUU | 1663 |
| UUUCUGUAUCCGUGCUCCAC | 1664 |
| AGUUUCUGUAUCCGUGCUCC | 1665 |
| CAGUUUCUGUAUCCGUGCUC | 1666 |
| CUCAGUUUCUGUAUCCGUGC | 1667 |
| UGUCUCAGUUUCUGUAUCCG | 1668 |
| UGCCCUCAUCCAGUCUCCAC | 1669 |
| AUCUGCCCUCAUCCAGUCUC | 1670 |
| CAUCUGCCCUCAUCCAGUCU | 1671 |
| UCAUCUGCCCUCAUCCAGUC | 1672 |
| CCUCAUCUGCCCUCAUCCAG | 1673 |
| CUAACACUCUCUUCCUGUCC | 1674 |
| UCUAACACUCUCUUCCUGUC | 1675 |
| UUCUAACACUCUCUUCCUGU | 1676 |
| UAUAGGCUGUUUCUCAGUCC | 1677 |
| CCUUGGAGACUUAUUCUUUC | 1678 |
| GCUCCUUGGAGACUUAUUCU | 1679 |
| UGCUCCUUGGAGACUUAUUC | 1680 |
| UUUUGUGCUCCUUGGAGACU | 1681 |

TABLE 3

| Sequence | SEQ ID NO: |
|---|---|
| AGCUUGAGUCUCUGACAGGG | 1682 |
| UUUUCUCUCUUUCCUUGCUC | 1683 |
| CCUCGCCACUUUGUUGUUUU | 1684 |
| GCCUCGCCACUUUGUUGUUU | 1685 |
| GGCCUCGCCACUUUGUUGUU | 1686 |
| GGGCCUCGCCACUUUGUUGU | 1687 |
| AGGGCCUCGCCACUUUGUUG | 1688 |
| GAGGGCCUCGCCACUUUGUU | 1689 |
| UGAGGGCCUCGCCACUUUGU | 1690 |
| UCUGAGGGCCUCGCCACUUU | 1691 |
| UUUCACUCUGAGGGCCUCGC | 1692 |
| CGCUUUCACUCUGAGGGCCU | 1693 |
| UACGCUUUCACUCUGAGGGC | 1694 |
| UUACGCUUUCACUCUGAGGG | 1695 |
| CUUACGCUUUCACUCUGAGG | 1696 |
| CCUUACGCUUUCACUCUGAG | 1697 |
| AACCUUACGCUUUCACUCUG | 1698 |
| GAACCUUACGCUUUCACUCU | 1699 |
| UGACUGAACCUUACGCUUUC | 1700 |
| CUGACUGAACCUUACGCUUU | 1701 |
| GCUGACUGAACCUUACGCUU | 1702 |
| GGCUGACUGAACCUUACGCU | 1703 |
| AGGCUGACUGAACCUUACGC | 1704 |
| GGUUUGGGUGAGGAAGGCUC | 1705 |
| GGGUUUGGGUGAGGAAGGCU | 1706 |
| UGUGGGUUUGGGUGAGGAAG | 1707 |
| UUGUGGGUUUGGGUGAGGAA | 1708 |
| UUUUGUGGGUUUGGGUGAGG | 1709 |
| GAAAAUGCAGAGCCAGGUCA | 1710 |
| CCACGAUGAAAAUGCAGAGC | 1711 |
| GCCACGAUGAAAAUGCAGAG | 1712 |
| AGGCCACGAUGAAAAUGCAG | 1713 |
| AAAGGCCACGAUGAAAAUGC | 1714 |
| ACAAAGGCCACGAUGAAAAU | 1715 |
| UGACAAAGGCCACGAUGAAA | 1716 |
| CUGACAAAGGCCACGAUGAA | 1717 |
| GCUGACAAAGGCCACGAUGA | 1718 |
| GGCUGACAAAGGCCACGAUG | 1719 |
| ACGCUGGGUGGCUGACAAAG | 1720 |

TABLE 3-continued

| Sequence | SEQ ID NO: |
|---|---|
| GUGCUUAGAGAGCUUCUGCA | 1721 |
| UGUGCUUAGAGAGCUUCUGC | 1722 |
| UUGUGCUUAGAGAGCUUCUG | 1723 |
| UCUUGUGCUUAGAGAGCUUC | 1724 |
| GUCUUGUGCUUAGAGAGCUU | 1725 |
| UGUCUUGUGCUUAGAGAGCU | 1726 |
| GUGUCUUGUGCUUAGAGAGC | 1727 |
| GGUGUCUUGUGCUUAGAGAG | 1728 |
| CUGGUGUCUUGUGCUUAGAG | 1729 |
| GCUGGUGUCUUGUGCUUAGA | 1730 |
| UGUGCUGGUGUCUUGUGCUU | 1731 |
| CUGUGCUGGUGUCUUGUGCU | 1732 |
| GGCUGUGCUGGUGUCUUGUG | 1733 |
| CGCUUUGAGCUGUGGCUGUG | 1734 |
| CCGCUUUGAGCUGUGGCUGU | 1735 |
| ACCUCCUCACAGCAGUUGGC | 1736 |
| UCACCUCCUCACAGCAGUUG | 1737 |
| GUUGGCAACUUGGGCCUUGA | 1738 |
| GGUUGGCAACUUGGGCCUUG | 1739 |
| AGGUUGGCAACUUGGGCCUU | 1740 |
| AAGGUUGGCAACUUGGGCCU | 1741 |
| UAAGGUUGGCAACUUGGGCC | 1742 |
| CUAAGGUUGGCAACUUGGGC | 1743 |
| GCUAAGGUUGGCAACUUGGG | 1744 |
| UGCUAAGGUUGGCAACUUGG | 1745 |
| CUGCUAAGGUUGGCAACUUG | 1746 |
| GCUGCUAAGGUUGGCAACUU | 1747 |
| GGCUGCUAAGGUUGGCAACU | 1748 |
| AGGCUGCUAAGGUUGGCAAC | 1749 |
| CAGGCUGCUAAGGUUGGCAA | 1750 |
| CAGUUCACUCAGCAGGCUGC | 1751 |
| UCAGUUCACUCAGCAGGCUG | 1752 |
| UUCAGUUCACUCAGCAGGCU | 1753 |
| GUUCAGUUCACUCAGCAGGC | 1754 |
| CUUGUUCAGUUCACUCAGCA | 1755 |
| UCUUGUUCAGUUCACUCAGC | 1756 |
| UUCUUGUUCAGUUCACUCAG | 1757 |
| GUCCCUCUCCUGCUUCUUGU | 1758 |
| AUGACCACGCUGACCCAGUC | 1759 |

TABLE 3-continued

| Sequence | SEQ ID NO: |
|---|---|
| UGCAUGACCACGCUGACCCA | 1760 |
| ACCUGCAUGACCACGCUGAC | 1761 |
| CACCUGCAUGACCACGCUGA | 1762 |
| UCACCUGCAUGACCACGCUG | 1763 |
| AUCACCUGCAUGACCACGCU | 1764 |
| CUCCAUCACCUGCAUGACCA | 1765 |
| CGCUUGCUGUUGCUCUCCAG | 1766 |
| GCGCUUGCUGUUGCUCUCCA | 1767 |
| CAUGCGCUUGCUGUUGCUCU | 1768 |
| CCAUGCGCUUGCUGUUGCUC | 1769 |
| UCCAUGCGCUUGCUGUUGCU | 1770 |
| CUCCAUGCGCUUGCUGUUGC | 1771 |
| ACUCCAUGCGCUUGCUGUUG | 1772 |
| GACUCCAUGCGCUUGCUGUU | 1773 |
| CGACUCCAUGCGCUUGCUGU | 1774 |
| GGUUGUUCAUCUCGGAGUAC | 1775 |
| UGGUUGUUCAUCUCGGAGUA | 1776 |
| UUGGUUGUUCAUCUCGGAGU | 1777 |
| GCAUGAUGUCAAUUUGGUUG | 1778 |
| AGCUGCAUGAUGUCAAUUUG | 1779 |
| AGUGACCGUCUGUGCUGCCU | 1780 |
| UGAGUGACCGUCUGUGCUGC | 1781 |
| CUGAGUGACCGUCUGUGCUG | 1782 |
| UCUGAGUGACCGUCUGUGCU | 1783 |
| UCUGCGGAGGUCUGAGUGAC | 1784 |
| AUCUGCGGAGGUCUGAGUGA | 1785 |
| CAUCUGCGGAGGUCUGAGUG | 1786 |
| GCAUCUGCGGAGGUCUGAGU | 1787 |
| UGGCAUCUGCGGAGGUCUGA | 1788 |
| AUGGCAUCUGCGGAGGUCUG | 1789 |
| GAUGGCAUCUGCGGAGGUCU | 1790 |
| GAGCAGUCGUAGAUGGCAUC | 1791 |
| AGAGCAGUCGUAGAUGGCAU | 1792 |
| AAGAGCAGUCGUAGAUGGCA | 1793 |
| GAAGAGCAGUCGUAGAUGGC | 1794 |
| GGAAGAGCAGUCGUAGAUGG | 1795 |
| GGGAAGAGCAGUCGUAGAUG | 1796 |
| AGGGAAGAGCAGUCGUAGAU | 1797 |
| GAGGGAAGAGCAGUCGUAGA | 1798 |

TABLE 3-continued

| Sequence | SEQ ID NO: |
|---|---|
| GGUAGUUCUUCUGGUAGAGG | 1799 |
| AGCUUAUACACUCCAGAGAU | 1800 |
| GAAGUCAUCAGGAGGAAGCU | 1801 |
| GGAAGUCAUCAGGAGGAAGC | 1802 |
| GCCCAGGAAGUCAUCAGGAG | 1803 |
| GCUGCCCAGGAAGUCAUCAG | 1804 |
| AGUUCAGGGCUGCCCAGGAA | 1805 |
| ACACCUCCAGUUCAGGGCUG | 1806 |
| AACACCUCCAGUUCAGGGCU | 1807 |
| CCGCCUGAAGUCUCCAUGUC | 1808 |
| UCCGCCUGAAGUCUCCAUGU | 1809 |
| CUCCGCCUGAAGUCUCCAUG | 1810 |
| CCUCCGCCUGAAGUCUCCAU | 1811 |
| AGAAGGAGACAAGGCCACUU | 1812 |
| UAGAAGGAGACAAGGCCACU | 1813 |
| UCCCGGUAGAAGGAGACAAG | 1814 |
| GUCCCGGUAGAAGGAGACAA | 1815 |
| AGUCCCGGUAGAAGGAGACA | 1816 |
| CAGUCCCGGUAGAAGGAGAC | 1817 |
| CCAGUCCCGGUAGAAGGAGA | 1818 |
| UCCAGUCCCGGUAGAAGGAG | 1819 |
| UUCCAGUCCCGGUAGAAGGA | 1820 |
| UGCUUCCAGUCCCGGUAGAA | 1821 |
| CUGCUUCCAGUCCCGGUAGA | 1822 |
| CCUGCUUGUACUGCUUCCAG | 1823 |
| CCCUGCUUGUACUGCUUCCA | 1824 |
| GAUGCUGCCAAAGCCCUGCU | 1825 |
| ACGGAUGCUGCCAAAGCCCU | 1826 |
| CGGUGGAUGUGUUCGUUCCC | 1827 |
| CCGGUGGAUGUGUUCGUUCC | 1828 |
| GCCGGUGGAUGUGUUCGUUC | 1829 |
| AGCCGGUGGAUGUGUUCGUU | 1830 |
| GAGCCGGUGGAUGUGUUCGU | 1831 |
| AGAGCCGGUGGAUGUGUUCG | 1832 |
| GAGAGCCGGUGGAUGUGUUC | 1833 |
| GGAGAGCCGGUGGAUGUGUU | 1834 |
| UGGAGAGCCGGUGGAUGUGU | 1835 |
| UCUGGAGAGCCGGUGGAUGU | 1836 |
| UGUCUGGAGAGCCGGUGGAU | 1837 |

TABLE 3-continued

| Sequence | SEQ ID NO: |
|---|---|
| CCAGUCCUCCAUCUCUACAC | 1838 |
| CCUCCCAGUCCUCCAUCUCU | 1839 |
| UUGCCCUCCCAGUCCUCCAU | 1840 |
| ACUCAGCGUAGCGCAGGUUG | 1841 |
| UACUCAGCGUAGCGCAGGUU | 1842 |
| UAUACUCAGCGUAGCGCAGG | 1843 |
| CUAUACUCAGCGUAGCGCAG | 1844 |
| ACAAAGUGGCUAUACUCAGC | 1845 |
| AACAAAGUGGCUAUACUCAG | 1846 |
| CAUUGCCCAAAACAAAGUGG | 1847 |
| GUUGAGUUCAUUGCCCAAAA | 1848 |
| UGUUGAGUUCAUUGCCCAAA | 1849 |
| CUGUUGAGUUCAUUGCCCAA | 1850 |
| GCUGUUGAGUUCAUUGCCCA | 1851 |
| CGAUAGCUGUUGAGUUCAUU | 1852 |
| GGCGAUAGCUGUUGAGUUCA | 1853 |
| AGGCGAUAGCUGUUGAGUUC | 1854 |
| GAGGCGAUAGCUGUUGAGUU | 1855 |
| AGAGGCGAUAGCUGUUGAGU | 1856 |
| AAGAGGCGAUAGCUGUUGAG | 1857 |
| GAAGAGGCGAUAGCUGUUGA | 1858 |
| GGAAGAGGCGAUAGCUGUUG | 1859 |
| AGGAAGAGGCGAUAGCUGUU | 1860 |
| CAGGAAGAGGCGAUAGCUGU | 1861 |
| CCAGGAAGAGGCGAUAGCUG | 1862 |
| CCCAGGAAGAGGCGAUAGCU | 1863 |
| ACAUUGCCAGUGUAGUUCCC | 1864 |
| CACAUUGCCAGUGUAGUUCC | 1865 |
| CCACAUUGCCAGUGUAGUUC | 1866 |
| CCCACAUUGCCAGUGUAGUU | 1867 |
| AUACUGGAGGGCGUCGUUCC | 1868 |
| GAUACUGGAGGGCGUCGUUC | 1869 |
| UGAUACUGGAGGGCGUCGUU | 1870 |
| AUGAUACUGGAGGGCGUCGU | 1871 |
| UAUGAUACUGGAGGGCGUCG | 1872 |
| UUGUUAUGAUACUGGAGGGC | 1873 |
| GUUGUUAUGAUACUGGAGGG | 1874 |
| UGUUGUUAUGAUACUGGAGG | 1875 |
| CUGUGUUGUUAUGAUACUGG | 1876 |

TABLE 3-continued

| Sequence | SEQ ID NO: |
|---|---|
| GCUGUGUUGUUAUGAUACUG | 1877 |
| GGCUGUGUUGUUAUGAUACU | 1878 |
| AGGCUGUGUUGUUAUGAUAC | 1879 |
| GAAGGCUGUGUUGUUAUGAU | 1880 |
| UGAAGGCUGUGUUGUUAUGA | 1881 |
| CUGAAGGCUGUGUUGUUAUG | 1882 |
| GCUGAAGGCUGUGUUGUUAU | 1883 |
| UGCUGAAGGCUGUGUUGUUA | 1884 |
| UGUCCUUGUCCUUGGUGCUG | 1885 |
| UUGUCCUUGUCCUUGGUGCU | 1886 |
| GCAGUUGUCAUUGUCCUUGU | 1887 |
| CCAAGCAGUUGUCAUUGUCC | 1888 |
| UCCAAGCAGUUGUCAUUGUC | 1889 |
| UGUCCAAGCAGUUGUCAUUG | 1890 |
| UUGUCCAAGCAGUUGUCAUU | 1891 |
| CUUGUCCAAGCAGUUGUCAU | 1892 |
| ACUUGUCCAAGCAGUUGUCA | 1893 |
| CACUUGUCCAAGCAGUUGUC | 1894 |
| ACACUUGUCCAAGCAGUUGU | 1895 |
| CACACUUGUCCAAGCAGUUG | 1896 |
| GCACACUUGUCCAAGCAGUU | 1897 |
| UGCACACUUGUCCAAGCAGU | 1898 |
| CACCUUUGCGGAGCUGUGCA | 1899 |
| AGCCACCUUUGCGGAGCUGU | 1900 |
| UAGCCACCUUUGCGGAGCUG | 1901 |
| GUAGCCACCUUUGCGGAGCU | 1902 |
| AGUAGCCACCUUUGCGGAGC | 1903 |
| CAGUAGCCACCUUUGCGGAG | 1904 |
| CCAGUAGCCACCUUUGCGGA | 1905 |
| ACCAGUAGCCACCUUUGCGG | 1906 |
| UACCAGUAGCCACCUUUGCG | 1907 |
| GUACCAGUAGCCACCUUUGC | 1908 |
| UGUACCAGUAGCCACCUUUG | 1909 |
| UUGUACCAGUAGCCACCUUU | 1910 |
| GUUGUACCAGUAGCCACCUU | 1911 |
| AGUUGUACCAGUAGCCACCU | 1912 |
| CAGCAGUUGUACCAGUAGCC | 1913 |
| GCAGCAGUUGUACCAGUAGC | 1914 |
| GUGCAGCAGUUGUACCAGUA | 1915 |
| UGUGCAGCAGUUGUACCAGU | 1916 |
| CUGUGCAGCAGUUGUACCAG | 1917 |
| UCUGUGCAGCAGUUGUACCA | 1918 |
| GUCUGUGCAGCAGUUGUACC | 1919 |
| AGUCUGUGCAGCAGUUGUAC | 1920 |
| GAGUCUGUGCAGCAGUUGUA | 1921 |
| GGAGUCUGUGCAGCAGUUGU | 1922 |
| UUGGAGUCUGUGCAGCAGUU | 1923 |
| GUUGGAGUCUGUGCAGCAGU | 1924 |
| GAGGUUGGAGUCUGUGCAGC | 1925 |
| AUUGAGGUUGGAGUCUGUGC | 1926 |
| CAUUGAGGUUGGAGUCUGUG | 1927 |
| CCAUUGAGGUUGGAGUCUGU | 1928 |
| GUACACUCCAUUGAGGUUGG | 1929 |
| UAGUACACUCCAUUGAGGUU | 1930 |
| GGUAGUACACUCCAUUGAGG | 1931 |
| CGGUAGUACACUCCAUUGAG | 1932 |
| GCGGUAGUACACUCCAUUGA | 1933 |
| GGCGGUAGUACACUCCAUUG | 1934 |
| AGGCGGUAGUACACUCCAUU | 1935 |
| CAGGCGGUAGUACACUCCAU | 1936 |
| CCAGGCGGUAGUACACUCCA | 1937 |
| CUCACCCAGGCGGUAGUACA | 1938 |
| UGCUCACCCAGGCGGUAGUA | 1939 |
| GCUUAUUGUGCUCACCCAGG | 1940 |
| UGCUUAUUGUGCUCACCCAG | 1941 |
| GUGCUUAUUGUGCUCACCCA | 1942 |
| CCAGGUGCUUAUUGUGCUCA | 1943 |
| UCCAGGUGCUUAUUGUGCUC | 1944 |
| CCAUCCAGGUGCUUAUUGUG | 1945 |
| GCCAUCCAGGUGCUUAUUGU | 1946 |
| UGCCAUCCAGGUGCUUAUUG | 1947 |
| AUGCCAUCCAGGUGCUUAUU | 1948 |
| GAUGCCAUCCAGGUGCUUAU | 1949 |
| UGAUGCCAUCCAGGUGCUUA | 1950 |
| ACCAGGUGAUGCCAUCCAGG | 1951 |
| UACCAGGUGAUGCCAUCCAG | 1952 |
| UAGGUAGAUCCAUGCCAGCC | 1953 |
| GUAGGUAGAUCCAUGCCAGC | 1954 |

TABLE 3-continued

| Sequence | SEQ ID NO: |
|---|---|
| GAGUAGGUAGAUCCAUGCCA | 1955 |
| GGAGUAGGUAGAUCCAUGCC | 1956 |
| GGGAGUAGGUAGAUCCAUGC | 1957 |
| AGGGAGUAGGUAGAUCCAUG | 1958 |
| GAGGGAGUAGGUAGAUCCAU | 1959 |
| UGAGGGAGUAGGUAGAUCCA | 1960 |
| UUGAGGGAGUAGGUAGAUCC | 1961 |
| UUUGAGGGAGUAGGUAGAUC | 1962 |
| CGUUUGAGGGAGUAGGUAGA | 1963 |
| CCGUUUGAGGGAGUAGGUAG | 1964 |
| CCCGUUUGAGGGAGUAGGUA | 1965 |
| ACCCGUUUGAGGGAGUAGGU | 1966 |
| CACCCGUUUGAGGGAGUAGG | 1967 |
| CCACCCGUUUGAGGGAGUAG | 1968 |
| UCCACCCGUUUGAGGGAGUA | 1969 |
| AUCUCCACCCGUUUGAGGGA | 1970 |
| CAUCUCCACCCGUUUGAGGG | 1971 |
| UCAUCUCCACCCGUUUGAGG | 1972 |
| UUCAUCUCCACCCGUUUGAG | 1973 |
| UUUCAUCUCCACCCGUUUGA | 1974 |
| UUUUCAUCUCCACCCGUUUG | 1975 |
| AUUUUCAUCUCCACCCGUUU | 1976 |
| GGCGGAUUUUCAUCUCCACC | 1977 |
| GGCUUGAAGUCUUCUGGGCG | 1978 |
| AAGGCUUGAAGUCUUCUGGG | 1979 |
| CCUUUUAAGGCUUGAAGUCU | 1980 |
| CUCCUUUUAAGGCUUGAAGU | 1981 |
| CCUCCUUUUAAGGCUUGAAG | 1982 |
| ACGGCAGCCUCCUUUUAAGG | 1983 |
| CACGGCAGCCUCCUUUUAAG | 1984 |
| CUCCACGGCAGCCUCCUUUU | 1985 |
| UUUCUGUAUCCGUGCUCCAC | 1986 |
| AGUUUCUGUAUCCGUGCUCC | 1987 |
| CAGUUUCUGUAUCCGUGCUC | 1988 |
| CUCAGUUUCUGUAUCCGUGC | 1989 |
| UGUCUCAGUUUCUGUAUCCG | 1990 |
| UGCCCUCAUCCAGUCUCCAC | 1991 |
| AUCUGCCCUCAUCCAGUCUC | 1992 |
| CAUCUGCCCUCAUCCAGUCU | 1993 |

| Sequence | SEQ ID NO: |
|---|---|
| UCAUCUGCCCUCAUCCAGUC | 1994 |
| CCUCAUCUGCCCUCAUCCAG | 1995 |
| CUAACACUCUCUUCCUGUCC | 1996 |
| UCUAACACUCUCUUCCUGUC | 1997 |
| UUCUAACACUCUCUUCCUGU | 1998 |
| UAUAGGCUGUUUCUCAGUCC | 1999 |
| CCUUGGAGACUUAUUCUUUC | 2000 |
| GCUCCUUGGAGACUUAUUCU | 2001 |
| UGCUCCUUGGAGACUUAUUC | 2002 |
| UUUUGUGCUCCUUGGAGACU | 2003 |
| UACUGUAACAUCCUUGGUAC | 2004 |
| GUUUACUGUAACAUCCUUGG | 2005 |
| AGGAUGUGGCAGGACCCAGU | 2006 |
| AAGGAUGUGGCAGGACCCAG | 2007 |
| GAAGGAUGUGGCAGGACCCA | 2008 |
| UGAGAAGGAUGUGGCAGGAC | 2009 |
| CAGUCUACCACCUUGAGAAG | 2010 |
| CACUCAGUCUACCACCUUGA | 2011 |
| GGAUCUUGGGCAGAGAGACC | 2012 |
| GGGAUCUUGGGCAGAGAGAC | 2013 |
| AGGGAUCUUGGGCAGAGAGA | 2014 |
| CAGGGAUCUUGGGCAGAGAG | 2015 |
| UGUCAGGGAUCUUGGGCAGA | 2016 |
| AUGUCAGGGAUCUUGGGCAG | 2017 |
| UAUGUCAGGGAUCUUGGGCA | 2018 |
| CUAUGUCAGGGAUCUUGGGC | 2019 |
| GCUAUGUCAGGGAUCUUGGG | 2020 |
| UGCUAUGUCAGGGAUCUUGG | 2021 |
| CUGCUAUGUCAGGGAUCUUG | 2022 |
| AGCUACUGCUAUGUCAGGGA | 2023 |
| AAGCUACUGCUAUGUCAGGG | 2024 |
| AAGACAAGCUACUGCUAUGU | 2025 |
| CAUGUGGAAAAGACAAGCUA | 2026 |
| AUCAUGUGGAAAAGACAAGC | 2027 |
| GCCCUCACAUAGCCUAAGCC | 2028 |
| UUGCCCUCACAUAGCCUAAG | 2029 |
| UUUGCCCUCACAUAGCCUAA | 2030 |
| UUUUGCCCUCACAUAGCCUA | 2031 |
| GUUUUGCCCUCACAUAGCCU | 2032 |

TABLE 3-continued

| Sequence | SEQ ID NO: |
|---|---|
| UGUUUUGCCCUCACAUAGCC | 2033 |
| GUGUUUUGCCCUCACAUAGC | 2034 |
| GAUUUGUGUUUUGCCCUCAC | 2035 |
| GGAUUUGUGUUUUGCCCUCA | 2036 |
| AAGGGAUUUGUGUUUUGCCC | 2037 |
| ACUCCUUUCUCUAACACUCA | 2038 |
| CACCUGCCUCCUUCACUCCU | 2039 |
| UACCAUUUCCCACCUGCCUC | 2040 |
| AUACCAUUUCCCACCUGCCU | 2041 |
| UCCAGCCUGGGUCAGUUCCA | 2042 |
| UGCAGUGCCCUGGAGUUUCC | 2043 |
| GAUGCAGUGCCCUGGAGUUU | 2044 |
| CAGAUGCAGUGCCCUGGAGU | 2045 |
| UGAUCGCCAGAUGCAGUGCC | 2046 |
| CUGAUCGCCAGAUGCAGUGC | 2047 |
| ACAUGACCAAGGCGAGCAGG | 2048 |
| UACAUGACCAAGGCGAGCAG | 2049 |
| GCUGGUGCUUCAUUCCUUUC | 2050 |
| CUGCUGGUGCUUCAUUCCUU | 2051 |
| CCUGCUGGUGCUUCAUUCCU | 2052 |
| ACUCUGUCCACCUCCUGCUG | 2053 |
| AGAGACUCUGUCCACCUCCU | 2054 |
| AUGAGAGACUCUGUCCACCU | 2055 |
| CAUCCAUGAGAGACUCUGUC | 2056 |
| GCAUCCAUGAGAGACUCUGU | 2057 |
| GGCAUCCAUGAGAGACUCUG | 2058 |
| CCUUGAGCUUGUUUCUUACA | 2059 |
| UUCAACCAUUUCCUACAGAC | 2060 |
| CCAUCUACCUUCAGUUUUCA | 2061 |
| ACACCAUCUACCUUCAGUUU | 2062 |
| AACACCAUCUACCUUCAGUU | 2063 |
| UAACACCAUCUACCUUCAGU | 2064 |

TABLE 4

| Sense Sequence | SEQ ID NO: | Antisense Sequence | SEQ ID NO: |
|---|---|---|---|
| AAAGGCUAGCAAAGAGCAA | 2065 | UUGCUCUUUGCUAGCCUUU | 2066 |
| AAGGCUAGCAAAGAGCAAG | 2067 | CUUGCUCUUUGCUAGCCUU | 2068 |
| AGGCUAGCAAAGAGCAAGG | 2069 | CCUUGCUCUUUGCUAGCCU | 2070 |
| GGCUAGCAAAGAGCAAGGA | 2071 | UCCUUGCUCUUUGCUAGCC | 2072 |
| GCUAGCAAAGAGCAAGGAA | 2073 | UUCCUUGCUCUUUGCUAGC | 2074 |
| CAAAGUGGCGAGGCCCUCA | 2075 | UGAGGGCUCGCCACUUUG | 2076 |
| AAAGUGGCGAGGCCCUCAG | 2077 | CUGAGGGCCUCGCCACUUU | 2078 |
| AAGUGGCGAGGCCCUCAGA | 2079 | UCUGAGGGCUCGCCACUU | 2080 |
| GCGAGGCCCUCAGAGUGAA | 2081 | UUCACUCUGAGGGCCUCGC | 2082 |
| AAAGCGUAAGGUUCAGUCA | 2083 | UGACUGAACCUUACGCUUU | 2084 |
| AAGAGCCUUCCUCACCCAA | 2085 | UUGGGUGAGGAAGGCUCUU | 2086 |
| AGAGCCUUCCUCACCCAAA | 2087 | UUUGGGUGAGGAAGGCUCU | 2088 |
| AAAAGCCUCUCUCAGCUGU | 2089 | ACAGCUGAGAGAGGCUUUU | 2090 |
| AAAGCCUCUCUCAGCUGUG | 2091 | CACAGCUGAGAGAGGCUUU | 2092 |
| UCAGCUGUGACCUGGCUCU | 2093 | AGAGCCAGGUCACAGCUGA | 2094 |
| UGACCUGGCUCUGCAUUUU | 2095 | AAAAUGCAGAGCCAGGUCA | 2096 |
| ACCUGGCUCUGCAUUUUCA | 2097 | UGAAAAUGCAGAGCCAGGU | 2098 |
| CCUGGCUCUGCAUUUUCAU | 2099 | AUGAAAAUGCAGAGCCAGG | 2100 |
| GCUCUGCAUUUUCAUCGUG | 2101 | CACGAUGAAAAUGCAGAGC | 2102 |
| CUCUGCAUUUUCAUCGUGG | 2103 | CCACGAUGAAAAUGCAGAG | 2104 |
| UCUGCAUUUUCAUCGUGGC | 2105 | GCCACGAUGAAAAUGCAGA | 2106 |
| CUGCAUUUUCAUCGUGGCC | 2107 | GGCCACGAUGAAAAUGCAG | 2108 |
| UGCAUUUUCAUCGUGGCCU | 2109 | AGGCCACGAUGAAAAUGCA | 2110 |
| GCAUUUUCAUCGUGGCCUU | 2111 | AAGGCCACGAUGAAAAUGC | 2112 |
| AUUUUCAUCGUGGCCUUUG | 2113 | CAAAGGCCACGAUGAAAAU | 2114 |
| UUUUCAUCGUGGCCUUUGU | 2115 | ACAAAGGCCACGAUGAAAA | 2116 |
| UUUCAUCGUGGCCUUUGUC | 2117 | GACAAAGGCCACGAUGAAA | 2118 |
| UUCAUCGUGGCCUUUGUCA | 2119 | UGACAAAGGCCACGAUGAA | 2120 |
| UCAUCGUGGCCUUUGUCAG | 2121 | CUGACAAAGGCCACGAUGA | 2122 |
| CAUCGUGGCCUUUGUCAGC | 2123 | GCUGACAAAGGCCACGAUG | 2124 |
| AUCGUGGCCUUUGUCAGCC | 2125 | GGCUGACAAAGGCCACGAU | 2126 |
| CCUUUGUCAGCCACCCAGC | 2127 | GCUGGGUGGCUGACAAAGG | 2128 |
| CUUUGUCAGCCACCCAGCG | 2129 | CGCUGGGUGGCUGACAAAG | 2130 |
| UUGUCAGCCACCCAGCGUG | 2131 | CACGCUGGGUGGCUGACAA | 2132 |
| GUGGCUGCAGAAGCUCUCU | 2133 | AGAGAGCUUCUGCAGCCAC | 2134 |
| UGGCUGCAGAAGCUCUCUA | 2135 | UAGAGAGCUUCUGCAGCCA | 2136 |
| GGCUGCAGAAGCUCUCUAA | 2137 | UUAGAGAGCUUCUGCAGCC | 2138 |
| GCUGCAGAAGCUCUCUAAG | 2139 | CUUAGAGAGCUUCUGCAGC | 2140 |

In some embodiments, the siRNA molecules comprise or consist of the nucleotide sequences (sense and antisense strands) shown in Table 4, Table 5, and Table 6.

TABLE 4-continued

| Sense Sequence | SEQ ID NO: | Antisense Sequence | SEQ ID NO: |
|---|---|---|---|
| CUGCAGAAGCUCUCUAAGC | 2141 | GCUUAGAGAGCUUCUGCAG | 2142 |
| UGCAGAAGCUCUCUAAGCA | 2143 | UGCUUAGAGAGCUUCUGCA | 2144 |
| GCAGAAGCUCUCUAAGCAC | 2145 | GUGCUUAGAGAGCUUCUGC | 2146 |
| CCAGCACAGCCACAGCUCA | 2147 | UGAGCUGUGGCUGUGCUGG | 2148 |
| CAGCACAGCCACAGCUCAA | 2149 | UUGAGCUGUGGCUGUGCUG | 2150 |
| GCACAGCCACAGCUCAAAG | 2151 | CUUUGAGCUGUGGCUGUGC | 2152 |
| CACAGCCACAGCUCAAAGC | 2153 | GCUUUGAGCUGUGGCUGUG | 2154 |
| ACAGCCACAGCUCAAAGCG | 2155 | CGCUUUGAGCUGUGGCUGU | 2156 |
| CAGCCACAGCUCAAAGCGG | 2157 | CCGCUUUGAGCUGUGGCUG | 2158 |
| AGCCACAGCUCAAAGCGGC | 2159 | GCCGCUUUGAGCUGUGGCU | 2160 |
| GGCCAACUGCUGUGAGGAG | 2161 | CUCCUCACAGCAGUUGGCC | 2162 |
| GCCAACUGCUGUGAGGAGG | 2163 | CCUCCUCACAGCAGUUGGC | 2164 |
| CCAACUGCUGUGAGGAGGU | 2165 | ACCUCCUCACAGCAGUUGG | 2166 |
| CAACUGCUGUGAGGAGGUG | 2167 | CACCUCCUCACAGCAGUUG | 2168 |
| AACUGCUGUGAGGAGGUGA | 2169 | UCACCUCCUCACAGCAGUU | 2170 |
| ACUGCUGUGAGGAGGUGAA | 2171 | UUCACCUCCUCACAGCAGU | 2172 |
| CUCAAGGCCCAAGUUGCCA | 2173 | UGGCAACUUGGGCCUUGAG | 2174 |
| GCCCAAGUUGCCAACCUUA | 2175 | UAAGGUUGGCAACUUGGGC | 2176 |
| CCCAAGUUGCCAACCUUAG | 2177 | CUAAGGUUGGCAACUUGGG | 2178 |
| CCAAGUUGCCAACCUUAGC | 2179 | GCUAAGGUUGGCAACUUGG | 2180 |
| CAAGUUGCCAACCUUAGCA | 2181 | UGCUAAGGUUGGCAACUUG | 2182 |
| AAGUUGCCAACCUUAGCAG | 2183 | CUGCUAAGGUUGGCAACUU | 2184 |
| AGUUGCCAACCUUAGCAGC | 2185 | GCUGCUAAGGUUGGCAACU | 2186 |
| GACUGGGUCAGCGUGGUCA | 2187 | UGACCACGCUGACCCAGUC | 2188 |
| ACUGGGUCAGCGUGGUCAU | 2189 | AUGACCACGCUGACCCAGU | 2190 |
| CUGGGUCAGCGUGGUCAUG | 2191 | CAUGACCACGCUGACCCAG | 2192 |
| UGGGUCAGCGUGGUCAUGC | 2193 | GCAUGACCACGCUGACCCA | 2194 |
| GGGUCAGCGUGGUCAUGCA | 2195 | UGCAUGACCACGCUGACCC | 2196 |
| CAGCGUGGUCAUGCAGGUG | 2197 | CACCUGCAUGACCACGCUG | 2198 |
| AGCGUGGUCAUGCAGGUGA | 2199 | UCACCUGCAUGACCACGCU | 2200 |
| GCGUGGUCAUGCAGGUGAU | 2201 | AUCACCUGCAUGACCACGC | 2202 |
| CGUGGUCAUGCAGGUGAUG | 2203 | CAUCACCUGCAUGACCACG | 2204 |
| AGCAAGCGCAUGGAGCGCG | 2205 | GCGACUCCAUGCGCUUGCU | 2206 |
| CAACCAAAUUGACAUCAUG | 2207 | CAUGAUGUCAAUUUGGUUG | 2208 |
| ACCAAAUUGACAUCAUGCA | 2209 | UGCAUGAUGUCAAUUUGGU | 2210 |
| UUGACAUCAUGCAGCUGCA | 2211 | UGCAGCUGCAUGAUGUCAA | 2212 |
| CAGGCAGCACAGACGGUCA | 2213 | UGACCGUCUGUGCUGCCUG | 2214 |
| AGGCAGCACAGACGGUCAC | 2215 | GUGACCGUCUGUGCUGCCU | 2216 |
| GGCAGCACAGACGGUCACU | 2217 | AGUGACCGUCUGUGCUGCC | 2218 |
| GCAGCACAGACGGUCACUC | 2219 | GAGUGACCGUCUGUGCUGC | 2220 |
| GUCACUCAGACCUCCGCAG | 2221 | CUGCGGAGGUCUGAGUGAC | 2222 |
| UCACUCAGACCUCCGCAGG | 2223 | CCUGCGGAGGUCUGAGUGA | 2224 |
| CCCAUCUACAGCACUGCUU | 2225 | AAGCAGUGCUGUAGAUGGG | 2226 |
| CCAUCUACAGCACUGCUUC | 2227 | GAAGCAGUGCUGUAGAUGG | 2228 |
| CAUCUACAGCACUGCUUCU | 2229 | AGAAGCAGUGCUGUAGAUG | 2230 |
| AUCUACAGCACUGCUUCUA | 2231 | UAGAAGCAGUGCUGUAGAU | 2232 |
| UCUACAGCACUGCUUCUAC | 2233 | GUAGAAGCAGUGCUGUAGA | 2234 |
| CUACAGCACUGCUUCUACA | 2235 | UGUAGAAGCAGUGCUGUAG | 2236 |
| ACUGCUUCUACAUAUCCUG | 2237 | CAGGAUAUGUAGAAGCAGU | 2238 |
| CUUCUACAUAUCCUGGUCA | 2239 | UGACCAGGAUAUGUAGAAG | 2240 |
| UUCUACAUAUCCUGGUCAU | 2241 | AUGACCAGGAUAUGUAGAA | 2242 |
| CUACAUAUCCUGGUCAUCA | 2243 | UGAUGACCAGGAUAUGUAG | 2244 |
| GGGCCUCUUUUGUGGGUAC | 2245 | GUACCCACAAAAGAGGCCC | 2246 |
| GCCUCUUUUGUGGGUACAC | 2247 | GUGUACCCACAAAAGAGGC | 2248 |
| CCUCUUUUGUGGGUACACU | 2249 | AGUGUACCCACAAAAGAGG | 2250 |
| CUCUUUUGUGGGUACACUU | 2251 | AAGUGUACCCACAAAAGAG | 2252 |
| GUGGGUACACUUUCCCUUU | 2253 | AAAGGGAAAGUGUACCCAC | 2254 |
| UGGGUACACUUUCCCUUUA | 2255 | UAAAGGGAAAGUGUACCCA | 2256 |
| GGGUACACUUUCCCUUUAG | 2257 | CUAAAGGGAAAGUGUACCC | 2258 |
| GGUACACUUUCCCUUUAGU | 2259 | ACUAAAGGGAAAGUGUACC | 2260 |
| GUACACUUUCCCUUUAGUA | 2261 | UACUAAAGGGAAAGUGUAC | 2262 |
| UACACUUUCCCUUUAGUAA | 2263 | UUACUAAAGGGAAAGUGUA | 2264 |
| ACACUUUCCCUUUAGUAAA | 2265 | UUUACUAAAGGGAAAGUGU | 2266 |
| AGGCUUAUGCAGUAUUUCC | 2267 | GGAAAUACUGCAUAAGCCU | 2268 |
| ACUUCUAAUGCUAUGUAAG | 2269 | CUUACAUAGCAUUAGAAGU | 2270 |
| CUUCUAAUGCUAUGUAAGU | 2271 | ACUUACAUAGCAUUAGAAG | 2272 |
| UGCUAUGUAAGUUUACCUA | 2273 | UAGGUAAACUUACAUAGCA | 2274 |
| GCUAUGUAAGUUUACCUAA | 2275 | UUAGGUAAACUUACAUAGC | 2276 |
| CUAUGUAAGUUUACCUAAC | 2277 | GUUAGGUAAACUUACAUAG | 2278 |
| ACACCUUCACGGGUCUCUU | 2279 | AAGAGACCCGUGAAGGUGU | 2280 |
| CACCUUCACGGGUCUCUUU | 2281 | AAAGAGACCCGUGAAGGUG | 2282 |
| ACCUUCACGGGUCUCUUUU | 2283 | AAAAGAGACCCGUGAAGGU | 2284 |
| CCUUCACGGGUCUCUUUUA | 2285 | UAAAAGAGACCCGUGAAGG | 2286 |
| CUUCACGGGUCUCUUUUAU | 2287 | AUAAAAGAGACCCGUGAAG | 2288 |
| UUCACGGGUCUCUUUUAUC | 2289 | GAUAAAAGAGACCCGUGAA | 2290 |
| UCACGGGUCUCUUUUAUCC | 2291 | GGAUAAAAGAGACCCGUGA | 2292 |

TABLE 4-continued

| Sense Sequence | SEQ ID NO: | Antisense Sequence | SEQ ID NO: |
|---|---|---|---|
| GGGUCUCUUUUAUCCACAC | 2293 | GUGUGGAUAAAAGAGACCC | 2294 |
| CACAGUGUUUCAGCCUACC | 2295 | GGUAGGCUGAAACACUGUG | 2296 |
| GAUACUACAUGGUUUGCCC | 2297 | GGGCAAACCAUGUAGUAUC | 2298 |
| AUACUACAUGGUUUGCCCA | 2299 | UGGGCAAACCAUGUAGUAU | 2300 |
| UACUACAUGGUUUGCCCAA | 2301 | UUGGGCAAACCAUGUAGUA | 2302 |
| ACUACAUGGUUUGCCCAAA | 2303 | UUUGGGCAAACCAUGUAGU | 2304 |
| AAGUCACCCAGCAAGUCUU | 2305 | AAGACUUGCUGGGUGACUU | 2306 |
| CACCCAGCAAGUCUUAGAA | 2307 | UUCUAAGACUUGCUGGGUG | 2308 |
| GUCUUAGAAGCAGGGUUCA | 2309 | UGAACCCUGCUUCUAAGAC | 2310 |
| CUUAGAAGCAGGGUUCAAG | 2311 | CUUGAACCCUGCUUCUAAG | 2312 |
| UUAGAAGCAGGGUUCAAGU | 2313 | ACUUGAACCCUGCUUCUAA | 2314 |
| UAGAAGCAGGGUUCAAGUC | 2315 | GACUUGAACCCUGCUUCUA | 2316 |
| AGAAGCAGGGUUCAAGUCU | 2317 | AGACUUGAACCCUGCUUCU | 2318 |
| GAAGCAGGGUUCAAGUCUU | 2319 | AAGACUUGAACCCUGCUUC | 2320 |
| AAGCAGGGUUCAAGUCUUC | 2321 | GAAGACUUGAACCCUGCUU | 2322 |
| GGUUCAAGUCUUCCUGAUU | 2323 | AAUCAGGAAGACUUGAACC | 2324 |
| GUUCAAGUCUUCCUGAUUG | 2325 | CAAUCAGGAAGACUUGAAC | 2326 |
| UUCAAGUCUUCCUGAUUGG | 2327 | CCAAUCAGGAAGACUUGAA | 2328 |
| UCAAGUCUUCCUGAUUGGU | 2329 | ACCAAUCAGGAAGACUUGA | 2330 |
| CAAGUCUUCCUGAUUGGUG | 2331 | CACCAAUCAGGAAGACUUG | 2332 |
| AAGUCUUCCUGAUUGGUGU | 2333 | ACACCAAUCAGGAAGACUU | 2334 |
| AGUCUUCCUGAUUGGUGUA | 2335 | UACACCAAUCAGGAAGACU | 2336 |
| GUCUUCCUGAUUGGUGUAG | 2337 | CUACACCAAUCAGGAAGAC | 2338 |
| UCCUGAUUGGUGUAGCUCU | 2339 | AGAGCUACACCAAUCAGGA | 2340 |
| CCUGAUUGGUGUAGCUCUG | 2341 | CAGAGCUACACCAAUCAGG | 2342 |
| CUCUGCUACUUCCUCACCA | 2343 | UGGUGAGGAAGUAGCAGAG | 2344 |
| UCUGCUACUUCCUCACCAA | 2345 | UUGGUGAGGAAGUAGCAGA | 2346 |
| CUGCUACUUCCUCACCAAG | 2347 | CUUGGUGAGGAAGUAGCAG | 2348 |
| UGCUACUUCCUCACCAAGA | 2349 | UCUUGGUGAGGAAGUAGCA | 2350 |
| GCUACUUCCUCACCAAGAG | 2351 | CUCUUGGUGAGGAAGUAGC | 2352 |
| CUACUUCCUCACCAAGAGC | 2353 | GCUCUUGGUGAGGAAGUAG | 2354 |
| ACUUCCUCACCAAGAGCUG | 2355 | CAGCUCUUGGUGAGGAAGU | 2356 |
| CUUCCUCACCAAGAGCUGA | 2357 | UCAGCUCUUGGUGAGGAAG | 2358 |
| UUCCUCACCAAGAGCUGAC | 2359 | GUCAGCUCUUGGUGAGGAA | 2360 |
| UCCUCACCAAGAGCUGACA | 2361 | UGUCAGCUCUUGGUGAGGA | 2362 |
| CCUCACCAAGAGCUGACAG | 2363 | CUGUCAGCUCUUGGUGAGG | 2364 |
| CUCACCAAGAGCUGACAGG | 2365 | CCUGUCAGCUCUUGGUGAG | 2366 |
| UCACCAAGAGCUGACAGGC | 2367 | GCCUGUCAGCUCUUGGUGA | 2368 |
| CACCAAGAGCUGACAGGCU | 2369 | AGCCUGUCAGCUCUUGGUG | 2370 |
| CCAAGAGCUGACAGGCUAU | 2371 | AUAGCCUGUCAGCUCUUGG | 2372 |
| CAAGAGCUGACAGGCUAUA | 2373 | UAUAGCCUGUCAGCUCUUG | 2374 |
| AAGAGCUGACAGGCUAUAU | 2375 | AUAUAGCCUGUCAGCUCUU | 2376 |
| AGAGCUGACAGGCUAUAUC | 2377 | GAUAUAGCCUGUCAGCUCU | 2378 |
| GAGCUGACAGGCUAUAUCU | 2379 | AGAUAUAGCCUGUCAGCUC | 2380 |
| AGCUGACAGGCUAUAUCUC | 2381 | GAGAUAUAGCCUGUCAGCU | 2382 |
| GCUGACAGGCUAUAUCUCA | 2383 | UGAGAUAUAGCCUGUCAGC | 2384 |
| CUGACAGGCUAUAUCUCAA | 2385 | UUGAGAUAUAGCCUGUCAG | 2386 |
| UGACAGGCUAUAUCUCAAG | 2387 | CUUGAGAUAUAGCCUGUCA | 2388 |
| GACAGGCUAUAUCUCAAGA | 2389 | UCUUGAGAUAUAGCCUGUC | 2390 |
| ACAGGCUAUAUCUCAAGAA | 2391 | UUCUUGAGAUAUAGCCUGU | 2392 |
| UCCUCUGGAAGCAAAGUUU | 2393 | AAACUUUGCUUCCAGAGGA | 2394 |
| CCUCUGGAAGCAAAGUUUU | 2395 | AAAACUUUGCUUCCAGAGG | 2396 |
| CUCUGGAAGCAAAGUUUUG | 2397 | CAAAACUUUGCUUCCAGAG | 2398 |
| ACAGUUCUCUGGUGUUCCU | 2399 | AGGAACACCAGAGAACUGU | 2400 |
| CAGUUCUCUGGUGUUCCUA | 2401 | UAGGAACACCAGAGAACUG | 2402 |
| AGUUCUCUGGUGUUCCUAA | 2403 | UUAGGAACACCAGAGAACU | 2404 |
| GUUCUCUGGUGUUCCUAAG | 2405 | CUUAGGAACACCAGAGAAC | 2406 |
| UUCUCUGGUGUUCCUAAGA | 2407 | UCUUAGGAACACCAGAGAA | 2408 |
| CUGGUGUUCCUAAGAUUUA | 2409 | UAAAUCUUAGGAACACCAG | 2410 |
| UGGUGUUCCUAAGAUUUAC | 2411 | GUAAAUCUUAGGAACACCA | 2412 |
| GGUGUUCCUAAGAUUUACC | 2413 | GGUAAAUCUUAGGAACACC | 2414 |
| GUGUUCCUAAGAUUUACCA | 2415 | UGGUAAAUCUUAGGAACAC | 2416 |
| UGUUCCUAAGAUUUACCAG | 2417 | CUGGUAAAUCUUAGGAACA | 2418 |
| GUUCCUAAGAUUUACCAGG | 2419 | CCUGGUAAAUCUUAGGAAC | 2420 |
| CCUAAGAUUUACCAGGAAU | 2421 | AUUCCUGGUAAAUCUUAGG | 2422 |
| CUAAGAUUUACCAGGAAUG | 2423 | CAUUCCUGGUAAAUCUUAG | 2424 |
| UUUACCAGGAAUGAGCAUU | 2425 | AAUGCUCAUUCCUGGUAAA | 2426 |
| CCAGGAAUGAGCAUUAAUG | 2427 | CAUUAAUGCUCAUUCCUGG | 2428 |
| CAGGAAUGAGCAUUAAUGG | 2429 | CCAUUAAUGCUCAUUCCUG | 2430 |
| AGGAAUGAGCAUUAAUGGA | 2431 | UCCAUUAAUGCUCAUUCCU | 2432 |
| GGAAUGAGCAUUAAUGGAA | 2433 | UUCCAUUAAUGCUCAUUCC | 2434 |
| GAAUGAGCAUUAAUGGAAU | 2435 | AUUCCAUUAAUGCUCAUUC | 2436 |
| GCAUUAAUGGAAUUUGUG | 2437 | CACAAAUUCCAUUAAUGC | 2438 |
| UUAAUGGAAUUUGUGUCC | 2439 | GGACACAAAUUCCAUUAA | 2440 |
| UAAUGGAAUUUGUGUCCU | 2441 | AGGACACAAAUUCCAUUA | 2442 |
| AAUGGAAUUUGUGUCCUC | 2443 | GAGGACACAAAUUCCAUU | 2444 |

TABLE 4-continued

| Sense Sequence | SEQ ID NO: | Antisense Sequence | SEQ ID NO: |
|---|---|---|---|
| AUGGAAUUUUGUGUCCUCU | 2445 | AGAGGACACAAAAUUCCAU | 2446 |
| GGAAUUUUGUGUCCUCUCU | 2447 | AGAGAGGACACAAAAUUCC | 2448 |
| GAAUUUUGUGUCCUCUCUC | 2449 | GAGAGAGGACACAAAAUUC | 2450 |
| UUUUGUGUCCUCUCUCUGU | 2451 | ACAGAGAGGACACAAAA | 2452 |
| UUUGUGUCCUCUCUCUGUA | 2453 | UACAGAGAGGACACAAA | 2454 |
| UGUGUCCUCUCUCUGUAAA | 2455 | UUUACAGAGAGGACACA | 2456 |
| AACGUAACUCUUCUCAUUG | 2457 | CAAUGAGAAGAGUUACGUU | 2458 |
| ACGUAACUCUUCUCAUUGG | 2459 | CCAAUGAGAAGAGUUACGU | 2460 |
| CGUAACUCUUCUCAUUGGC | 2461 | GCCAAUGAGAAGAGUUACG | 2462 |
| GUAACUCUUCUCAUUGGCU | 2463 | AGCCAAUGAGAAGAGUUAC | 2464 |
| UAACUCUUCUCAUUGGCUC | 2465 | GAGCCAAUGAGAAGAGUUA | 2466 |
| AACUCUUCUCAUUGGCUCA | 2467 | UGAGCCAAUGAGAAGAGUU | 2468 |
| ACUCUUCUCAUUGGCUCAG | 2469 | CUGAGCCAAUGAGAAGAGU | 2470 |
| CUCUUCUCAUUGGCUCAGA | 2471 | UCUGAGCCAAUGAGAAGAG | 2472 |
| UCUCAUUGGCUCAGAGUUA | 2473 | UAACUCUGAGCCAAUGAGA | 2474 |
| AUUGGCUCAGAGUUAAGUG | 2475 | CACUUAACUCUGAGCCAAU | 2476 |
| UUGGCUCAGAGUUAAGUGU | 2477 | ACACUUAACUCUGAGCCAA | 2478 |
| UGGCUCAGAGUUAAGUGUA | 2479 | UACACUUAACUCUGAGCCA | 2480 |
| GGCUCAGAGUUAAGUGUAG | 2481 | CUACACUUAACUCUGAGCC | 2482 |
| GCUCAGAGUUAAGUGUAGA | 2483 | UCUACACUUAACUCUGAGC | 2484 |
| CUCAGAGUUAAGUGUAGAG | 2485 | CUCUACACUUAACUCUGAG | 2486 |
| CAUAACCAUGUGAAGAGUC | 2487 | GACUCUUCACAUGGUUAUG | 2488 |
| AUAACCAUGUGAAGAGUCC | 2489 | GGACUCUUCACAUGGUUAU | 2490 |
| UAACCAUGUGAAGAGUCCC | 2491 | GGGACUCUUCACAUGGUUA | 2492 |
| AACCAUGUGAAGAGUCCCU | 2493 | AGGGACUCUUCACAUGGUU | 2494 |
| ACCAUGUGAAGAGUCCCUU | 2495 | AAGGGACUCUUCACAUGGU | 2496 |
| CCAUGUGAAGAGUCCCUUU | 2497 | AAAGGGACUCUUCACAUGG | 2498 |
| CAUGUGAAGAGUCCCUUUG | 2499 | CAAAGGGACUCUUCACAUG | 2500 |
| AUGUGAAGAGUCCCUUUGU | 2501 | ACAAAGGGACUCUUCACAU | 2502 |
| GUGAAGAGUCCCUUUGUGU | 2503 | ACACAAAGGGACUCUUCAC | 2504 |
| UGAAGAGUCCCUUUGUGUU | 2505 | AACACAAAGGGACUCUUCA | 2506 |
| AAGAGUCCCUUUGUGUUCA | 2507 | UGAACACAAAGGGACUCUU | 2508 |
| AGAGUCCCUUUGUGUUCAG | 2509 | CUGAACACAAAGGGACUCU | 2510 |
| GAGUCCCUUUGUGUUCAGG | 2511 | CCUGAACACAAAGGGACUC | 2512 |
| UGUUCAGGAAGGAUGCGGC | 2513 | GCCGCAUCCUUCCUGAACA | 2514 |
| GUUCAGGAAGGAUGCGGCU | 2515 | AGCCGCAUCCUUCCUGAAC | 2516 |
| UUCAGGAAGGAUGCGGCUC | 2517 | GAGCCGCAUCCUUCCUGAA | 2518 |
| GGAUGCGGCUCCUUAAGGU | 2519 | ACCUUAAGGAGCCGCAUCC | 2520 |
| GAUGCGGCUCCUUAAGGUU | 2521 | AACCUUAAGGAGCCGCAUC | 2522 |
| AUGCGGCUCCUUAAGGUUC | 2523 | GAACCUUAAGGAGCCGCAU | 2524 |
| UGCGGCUCCUUAAGGUUCC | 2525 | GGAACCUUAAGGAGCCGCA | 2526 |
| GCGGCUCCUUAAGGUUCCU | 2527 | AGGAACCUUAAGGAGCCGC | 2528 |
| CGGCUCCUUAAGGUUCCUC | 2529 | GAGGAACCUUAAGGAGCCG | 2530 |
| UCCUUAAGGUUCCUCAAUU | 2531 | AAUUGAGGAACCUUAAGGA | 2532 |
| CCUUAAGGUUCCUCAAUUG | 2533 | CAAUUGAGGAACCUUAAGG | 2534 |
| CUUAAGGUUCCUCAAUUGU | 2535 | ACAAUUGAGGAACCUUAAG | 2536 |
| UUAAGGUUCCUCAAUUGUG | 2537 | CACAAUUGAGGAACCUUAA | 2538 |
| GGUUCCUCAAUUGUGAUAC | 2539 | GUAUCACAAUUGAGGAACC | 2540 |
| GUUCCUCAAUUGUGAUACG | 2541 | CGUAUCACAAUUGAGGAAC | 2542 |
| UUCCUCAAUUGUGAUACGU | 2543 | ACGUAUCACAAUUGAGGAA | 2544 |
| UCCUCAAUUGUGAUACGUC | 2545 | GACGUAUCACAAUUGAGGA | 2546 |
| CCUCAAUUGUGAUACGUCU | 2547 | AGACGUAUCACAAUUGAGG | 2548 |
| CUCAAUUGUGAUACGUCUA | 2549 | UAGACGUAUCACAAUUGAG | 2550 |
| UCAAUUGUGAUACGUCUAU | 2551 | AUAGACGUAUCACAAUUGA | 2552 |
| CAAUUGUGAUACGUCUAUU | 2553 | AAUAGACGUAUCACAAUUG | 2554 |
| UUUUCCAUGGUCUAAAUG | 2555 | CAUUUAAGACCAUGGAAAA | 2556 |
| AAUGAAUUUCUCCGAAUAC | 2557 | GUAUUCGGAGAAAUUCAUU | 2558 |
| AUGAAUUUCUCCGAAUACA | 2559 | UGUAUUCGGAGAAAUUCAU | 2560 |
| UGAAUUUCUCCGAAUACAG | 2561 | CUGUAUUCGGAGAAAUUCA | 2562 |
| UUUCUCCGAAUACAGGAUU | 2563 | AAUCCUGUAUUCGGAGAAA | 2564 |
| UUCUCCGAAUACAGGAUUU | 2565 | AAAUCCUGUAUUCGGAGAA | 2566 |
| UCUCCGAAUACAGGAUUUU | 2567 | AAAAUCCUGUAUUCGGAGA | 2568 |
| AAUAUAGACUUAAUAGGCC | 2569 | GGCCUAUUAAGUCUAUAUU | 2570 |
| AUAUAGACUUAAUAGGCCA | 2571 | UGGCCUAUUAAGUCUAUAU | 2572 |
| UAUAGACUUAAUAGGCCAA | 2573 | UUGGCCUAUUAAGUCUAUA | 2574 |
| AUAGACUUAAUAGGCCAAA | 2575 | UUUGGCCUAUUAAGUCUAU | 2576 |
| UAGACUUAAUAGGCCAAAA | 2577 | UUUUGGCCUAUUAAGUCUA | 2578 |
| ACUUUAUUUCUGGUUAGC | 2579 | GCUAACCAGAAAUAAAGU | 2580 |
| CUUUUAUUUCUGGUUAGCU | 2581 | AGCUAACCAGAAAUAAAG | 2582 |
| UUUUAUUUCUGGUUAGCUC | 2583 | GAGCUAACCAGAAAUAAA | 2584 |
| UUUAUUUCUGGUUAGCUCA | 2585 | UGAGCUAACCAGAAAUAAA | 2586 |
| UUAUUUCUGGUUAGCUCAG | 2587 | CUGAGCUAACCAGAAAUAA | 2588 |
| UUCUGGUUAGCUCAGCUCA | 2589 | UGAGCUGAGCUAACCAGAA | 2590 |
| UCUGGUUAGCUCAGCUCAG | 2591 | CUGAGCUGAGCUAACCAGA | 2592 |
| CUGGUUAGCUCAGCUCAGG | 2593 | CCUGAGCUGAGCUAACCAG | 2594 |
| UGGUUAGCUCAGCUCAGGU | 2595 | ACCUGAGCUGAGCUAACCA | 2596 |

TABLE 4-continued

| Sense Sequence | SEQ ID NO: | Antisense Sequence | SEQ ID NO: |
|---|---|---|---|
| GGUUAGCUCAGCUCAGGUG | 2597 | CACCUGAGCUGAGCUAACC | 2598 |
| GUUAGCUCAGCUCAGGUGG | 2599 | CCACCUGAGCUGAGCUAAC | 2600 |
| UUAGCUCAGCUCAGGUGGG | 2601 | CCCACCUGAGCUGAGCUAA | 2602 |
| UAGCUCAGCUCAGGUGGGC | 2603 | GCCCACCUGAGCUGAGCUA | 2604 |
| ACAUGAAUUUACGGUUUAG | 2605 | CUAAACCGUAAAUUCAUGU | 2606 |
| CAUGAAUUUACGGUUUAGA | 2607 | UCUAAACCGUAAAUUCAUG | 2608 |
| AUGAAUUUACGGUUUAGAG | 2609 | CUCUAAACCGUAAAUUCAU | 2610 |
| GGAGCAUAUCCUAUAGACA | 2611 | UGUCUAUAGGAUAUGCUCC | 2612 |
| CAUAUCCUAUAGACAUGUC | 2613 | GACAUGUCUAUAGGAUAUG | 2614 |
| CAAAGACAUGAUCAGCUUC | 2615 | GAAGCUGAUCAUGUCUUUG | 2616 |
| AAAGACAUGAUCAGCUUCU | 2617 | AGAAGCUGAUCAUGUCUUU | 2618 |
| AAGACAUGAUCAGCUUCUA | 2619 | UAGAAGCUGAUCAUGUCUU | 2620 |
| AGACAUGAUCAGCUUCUAC | 2621 | GUAGAAGCUGAUCAUGUCU | 2622 |
| CAGCUUCUACUGACUAAGU | 2623 | ACUUAGUCAGUAGAAGCUG | 2624 |
| AGCUUCUACUGACUAAGUC | 2625 | GACUUAGUCAGUAGAAGCU | 2626 |
| GACUAAGUCAAUGGUUAAC | 2627 | GUUAACCAUUGACUUAGUC | 2628 |
| ACUAAGUCAAUGGUUAACC | 2629 | GGUUAACCAUUGACUUAGU | 2630 |
| AAUGGUUAACCUCAGCUCA | 2631 | UGAGCUGAGGUUAACCAUU | 2632 |
| GUAUCAAUCACUUUCUAAG | 2633 | CUUAGAAAGUGAUUGAUAC | 2634 |
| UAUCAAUCACUUUCUAAGC | 2635 | GCUUAGAAAGUGAUUGAUA | 2636 |
| AUCAAUCACUUUCUAAGCA | 2637 | UGCUUAGAAAGUGAUUGAU | 2638 |
| UCAAUCACUUUCUAAGCAU | 2639 | AUGCUUAGAAAGUGAUUGA | 2640 |
| CAAUCACUUUCUAAGCAUG | 2641 | CAUGCUUAGAAAGUGAUUG | 2642 |
| AAUCACUUUCUAAGCAUGG | 2643 | CCAUGCUUAGAAAGUGAUU | 2644 |
| AUCACUUUCUAAGCAUGGA | 2645 | UCCAUGCUUAGAAAGUGAU | 2646 |
| UCACUUUCUAAGCAUGGAC | 2647 | GUCCAUGCUUAGAAAGUGA | 2648 |
| CACUUUCUAAGCAUGGACU | 2649 | AGUCCAUGCUUAGAAAGUG | 2650 |
| ACUUUCUAAGCAUGGACUU | 2651 | AAGUCCAUGCUUAGAAAGU | 2652 |
| CUUUCUAAGCAUGGACUUC | 2653 | GAAGUCCAUGCUUAGAAAG | 2654 |
| UUUCUAAGCAUGGACUUCC | 2655 | GGAAGUCCAUGCUUAGAAA | 2656 |
| UUCUAAGCAUGGACUUCCG | 2657 | CGGAAGUCCAUGCUUAGAA | 2658 |
| UCUAAGCAUGGACUUCCGG | 2659 | CCGGAAGUCCAUGCUUAGA | 2660 |
| CUAAGCAUGGACUUCCGGG | 2661 | CCCGGAAGUCCAUGCUUAG | 2662 |
| CCUCAGUUUGGGAUUAGAA | 2663 | UUCUAAUCCCAAACUGAGG | 2664 |
| AAAGGUAUUCUCAGGCCAU | 2665 | AUGGCCUGAGAAUACCUUU | 2666 |
| AAGGUAUUCUCAGGCCAUU | 2667 | AAUGGCCUGAGAAUACCUU | 2668 |
| AGGUAUUCUCAGGCCAUUU | 2669 | AAAUGGCCUGAGAAUACCU | 2670 |
| GGUAUUCUCAGGCCAUUUU | 2671 | AAAAUGGCCUGAGAAUACC | 2672 |
| UAUUCUCAGGCCAUUUUCC | 2673 | GGAAAAUGGCCUGAGAAUA | 2674 |
| AUUCUCAGGCCAUUUUCCA | 2675 | UGGAAAAUGGCCUGAGAAU | 2676 |
| UUCUCAGGCCAUUUUCCAG | 2677 | CUGGAAAAUGGCCUGAGAA | 2678 |
| UCUCAGGCCAUUUUCCAGA | 2679 | UCUGGAAAAUGGCCUGAGA | 2680 |
| AAGUGAGUCCUGAUUUGGU | 2681 | ACCAAAUCAGGACUCACUU | 2682 |
| AGUGAGUCCUGAUUUGGUC | 2683 | GACCAAAUCAGGACUCACU | 2684 |
| GUGAGUCCUGAUUUGGUCU | 2685 | AGACCAAAUCAGGACUCAC | 2686 |
| GAGUCCUGAUUUGGUCUGU | 2687 | ACAGACCAAAUCAGGACUC | 2688 |
| AGUCCUGAUUUGGUCUGUG | 2689 | CACAGACCAAAUCAGGACU | 2690 |
| AACCAGACAUGCGGAAGAC | 2691 | GUCUUCCGCAUGUCUGGUU | 2692 |
| ACCAGACAUGCGGAAGACC | 2693 | GGUCUUCCGCAUGUCUGGU | 2694 |
| CCAGACAUGCGGAAGACCA | 2695 | UGGUCUUCCGCAUGUCUGG | 2696 |
| ACAUGCGGAAGACCAGGCC | 2697 | GGCCUGGUCUUCCGCAUGU | 2698 |
| CAUGCGGAAGACCAGGCCA | 2699 | UGGCCUGGUCUUCCGCAUG | 2700 |
| AUGCGGAAGACCAGGCCAG | 2701 | CUGGCCUGGUCUUCCGCAU | 2702 |
| UGCGGAAGACCAGGCCAGA | 2703 | UCUGGCCUGGUCUUCCGCA | 2704 |
| CGGAAGACCAGGCCAGACA | 2705 | UGUCUGGCCUGGUCUUCCG | 2706 |
| GGAAGACCAGGCCAGACAG | 2707 | CUGUCUGGCCUGGUCUUCC | 2708 |
| GAAGACCAGGCCAGACAGA | 2709 | UCUGUCUGGCCUGGUCUUC | 2710 |
| AAGACCAGGCCAGACAGAG | 2711 | CUCUGUCUGGCCUGGUCUU | 2712 |
| AGACCAGGCCAGACAGAGG | 2713 | CCUCUGUCUGGCCUGGUCU | 2714 |
| GACCAGGCCAGACAGAGGA | 2715 | UCCUCUGUCUGGCCUGGUC | 2716 |
| AGGCCAGACAGAGGAAUCU | 2717 | AGAUUCCUCUGUCUGGCCU | 2718 |
| AGAGGAAUCUGACCGUGCC | 2719 | GGCACGGUCAGAUUCCUCU | 2720 |
| GAGGAAUCUGACCGUGCCA | 2721 | UGGCACGGUCAGAUUCCUC | 2722 |
| AGGAAUCUGACCGUGCCAC | 2723 | GUGGCACGGUCAGAUUCCU | 2724 |
| GGAAUCUGACCGUGCCACU | 2725 | AGUGGCACGGUCAGAUUCC | 2726 |
| GAAUCUGACCGUGCCACUU | 2727 | AAGUGGCACGGUCAGAUUC | 2728 |
| AAUCUGACCGUGCCACUUC | 2729 | GAAGUGGCACGGUCAGAUU | 2730 |
| AUCUGACCGUGCCACUUCC | 2731 | GGAAGUGGCACGGUCAGAU | 2732 |
| UCUGACCGUGCCACUUCCU | 2733 | AGGAAGUGGCACGGUCAGA | 2734 |
| ACCGUGCCACUUCCUGCUC | 2735 | GAGCAGGAAGUGGCACGGU | 2736 |
| CGUGCCACUUCCUGCUCAU | 2737 | AUGAGCAGGAAGUGGCACG | 2738 |
| GCCACUUCCUGCUCAUCCA | 2739 | UGGAUGAGCAGGAAGUGGC | 2740 |
| CCACUUCCUGCUCAUCCAA | 2741 | UUGGAUGAGCAGGAAGUGG | 2742 |
| CACUUCCUGCUCAUCCAAA | 2743 | UUUGGAUGAGCAGGAAGUG | 2744 |
| ACAGGAGGCUUUCUCACCA | 2745 | UGGUGAGAAAGCCUCCUGU | 2746 |
| GGAGGCUUUCUCACCAUCC | 2747 | GGAUGGUGAGAAAGCCUCC | 2748 |

TABLE 4-continued

| Sense Sequence | SEQ ID NO: | Antisense Sequence | SEQ ID NO: |
|---|---|---|---|
| GAGGCUUUCUCACCAUCCU | 2749 | AGGAUGGUGAGAAAGCCUC | 2750 |
| AGGCUUUCUCACCAUCCUG | 2751 | CAGGAUGGUGAGAAAGCCU | 2752 |
| GGCUUUCUCACCAUCCUGC | 2753 | GCAGGAUGGUGAGAAAGCC | 2754 |
| GCUUUCUCACCAUCCUGCA | 2755 | UGCAGGAUGGUGAGAAAGC | 2756 |
| CUUUCUCACCAUCCUGCAA | 2757 | UUGCAGGAUGGUGAGAAAG | 2758 |
| UUUCUCACCAUCCUGCAAG | 2759 | CUUGCAGGAUGGUGAGAAA | 2760 |
| UUCUCACCAUCCUGCAAGG | 2761 | CCUUGCAGGAUGGUGAGAA | 2762 |
| UGCAGCUCUCCCACCAGGU | 2763 | ACCUGGUGGGAGAGCUGCA | 2764 |
| AGCUCUCCCACCAGGUCUC | 2765 | GAGACCUGGUGGGAGAGCU | 2766 |
| UCUUGCCCAGGACAUCAUU | 2767 | AAUGAUGUCCUGGGCAAGA | 2768 |
| CUUGCCCAGGACAUCAUUC | 2769 | GAAUGAUGUCCUGGGCAAG | 2770 |
| GGACAUCAUUCCUUAUUUU | 2771 | AAAAUAAGGAAUGAUGUCC | 2772 |
| UCAGUUACCCUUAUAUUCU | 2773 | AGAAUAUAAGGGUAACUGA | 2774 |
| CAGUUACCCUUAUAUUCUA | 2775 | UAGAAUAUAAGGGUAACUG | 2776 |
| AUUCUAUAAGUAGGUAGUC | 2777 | GACUACCUACUUAUAGAAU | 2778 |
| UUCUAUAAGUAGGUAGUCC | 2779 | GGACUACCUACUUAUAGAA | 2780 |
| UCUAUAAGUAGGUAGUCCC | 2781 | GGGACUACCUACUUAUAGA | 2782 |
| CUAUAAGUAGGUAGUCCCU | 2783 | AGGGACUACCUACUUAUAG | 2784 |
| UAUAAGUAGGUAGUCCCUU | 2785 | AAGGGACUACCUACUUAUA | 2786 |
| GCAGUAAGUUGGUGCUUUC | 2787 | GAAAGCACCAACUUACUGC | 2788 |
| CUUUCACCACUAAGACGAA | 2789 | UUCGUCUUAGUGGUGAAAG | 2790 |
| ACACGUACUCUACCUCCCU | 2791 | AGGGAGGUAGAGUACGUGU | 2792 |
| CACGUACUCUACCUCCCUU | 2793 | AAGGGAGGUAGAGUACGUG | 2794 |
| ACGUACUCUACCUCCCUUU | 2795 | AAAGGGAGGUAGAGUACGU | 2796 |
| CCCAAGGUGCUCUGCAAGA | 2797 | UCUUGCAGAGCACCUUGGG | 2798 |
| AACCUAUGUGCCUCAGACA | 2799 | UGUCUGAGGCACAUAGGUU | 2800 |
| UCCCAUCUGCCAUCUUGGU | 2801 | ACCAAGAUGGCAGAUGGGA | 2802 |
| CCCAUCUGCCAUCUUGGUG | 2803 | CACCAAGAUGGCAGAUGGG | 2804 |
| CCAUCUUGGUGCUCCUCUC | 2805 | GAGAGGAGCACCAAGAUGG | 2806 |
| AUCUUGGUGCUCCUCUCUA | 2807 | UAGAGAGGAGCACCAAGAU | 2808 |
| UCUUGGUGCUCCUCUCUAA | 2809 | UUAGAGAGGAGCACCAAGA | 2810 |
| CUUGGUGCUCCUCUCUAAG | 2811 | CUUAGAGAGGAGCACCAAG | 2812 |
| UUGGUGCUCCUCUCUAAGG | 2813 | CCUUAGAGAGGAGCACCAA | 2814 |
| UGGUGCUCCUCUCUAAGGU | 2815 | ACCUUAGAGAGGAGCACCA | 2816 |
| GGUGCUCCUCUCUAAGGUC | 2817 | GACCUUAGAGAGGAGCACC | 2818 |
| UGCUCCUCUCUAAGGUCCC | 2819 | GGGACCUUAGAGAGGAGCA | 2820 |
| GCUCCUCUCUAAGGUCCCA | 2821 | UGGGACCUUAGAGAGGAGC | 2822 |
| CUCUCUAAGGUCCCAGUGC | 2823 | GCACUGGGACCUUAGAGAG | 2824 |
| UCUCUAAGGUCCCAGUGCA | 2825 | UGCACUGGGACCUUAGAGA | 2826 |
| GGUCCCAGUGCAGUGGUCA | 2827 | UGACCACUGCACUGGGACC | 2828 |
| GUCCCAGUGCAGUGGUCAC | 2829 | GUGACCACUGCACUGGGAC | 2830 |
| UCCCAGUGCAGUGGUCACC | 2831 | GGUGACCACUGCACUGGGA | 2832 |
| CCCAGUGCAGUGGUCACCA | 2833 | UGGUGACCACUGCACUGGG | 2834 |
| CCAGUGCAGUGGUCACCAA | 2835 | UUGGUGACCACUGCACUGG | 2836 |
| CAGUGCAGUGGUCACCAAG | 2837 | CUUGGUGACCACUGCACUG | 2838 |
| AGUGCAGUGGUCACCAAGA | 2839 | UCUUGGUGACCACUGCACU | 2840 |
| GUGCAGUGGUCACCAAGAA | 2841 | UUCUUGGUGACCACUGCAC | 2842 |
| AGACAUAGCAGGCAGGAAG | 2843 | CUUCCUGCCUGCUAUGUCU | 2844 |
| ACAUAGCAGGCAGGAAGCU | 2845 | AGCUUCCUGCCUGCUAUGU | 2846 |
| CAUAGCAGGCAGGAAGCUU | 2847 | AAGCUUCCUGCCUGCUAUG | 2848 |
| AUAGCAGGCAGGAAGCUUC | 2849 | GAAGCUUCCUGCCUGCUAU | 2850 |
| UAGCAGGCAGGAAGCUUCU | 2851 | AGAAGCUUCCUGCCUGCUA | 2852 |
| GCAGGCAGGAAGCUUCUCU | 2853 | AGAGAAGCUUCCUGCCUGC | 2854 |
| GCCGCAGUCUCUGAAUCCU | 2855 | AGGAUUCAGAGACUGCGGC | 2856 |
| CCGCAGUCUCUGAAUCCUA | 2857 | UAGGAUUCAGAGACUGCGG | 2858 |
| CGCAGUCUCUGAAUCCUAU | 2859 | AUAGGAUUCAGAGACUGCG | 2860 |
| GCAGUCUCUGAAUCCUAUC | 2861 | GAUAGGAUUCAGAGACUGC | 2862 |
| CAGUCUCUGAAUCCUAUCA | 2863 | UGAUAGGAUUCAGAGACUG | 2864 |
| AAGGCUGUCUCUUCCACUA | 2865 | UAGUGGAAGAGACAGCCUU | 2866 |
| AGGCUGUCUCUUCCACUAU | 2867 | AUAGUGGAAGAGACAGCCU | 2868 |
| GGCUGUCUCUUCCACUAUG | 2869 | CAUAGUGGAAGAGACAGCC | 2870 |
| GCUGUCUCUUCCACUAUGC | 2871 | GCAUAGUGGAAGAGACAGC | 2872 |
| CUGUCUCUUCCACUAUGCU | 2873 | AGCAUAGUGGAAGAGACAG | 2874 |
| UGUCUCUUCCACUAUGCUC | 2875 | GAGCAUAGUGGAAGAGACA | 2876 |
| GUCUCUUCCACUAUGCUCU | 2877 | AGAGCAUAGUGGAAGAGAC | 2878 |
| UCUCUUCCACUAUGCUCUU | 2879 | AAGAGCAUAGUGGAAGAGA | 2880 |
| CUCUUCCACUAUGCUCUUU | 2881 | AAAGAGCAUAGUGGAAGAG | 2882 |
| CUUCCACUAUGCUCUUUGA | 2883 | UCAAAGAGCAUAGUGGAAG | 2884 |
| UUCCACUAUGCUCUUUGAU | 2885 | AUCAAAGAGCAUAGUGGAA | 2886 |
| UCCACUAUGCUCUUUGAUA | 2887 | UAUCAAAGAGCAUAGUGGA | 2888 |
| AGAAUACAGAGCUUAAAUC | 2889 | GAUUUAAGCUCUGUAUUCU | 2890 |
| UACAGAGCUUAAAUCCUGC | 2891 | GCAGGAUUUAAGCUCUGUA | 2892 |
| ACAGAGCUUAAAUCCUGCA | 2893 | UGCAGGAUUUAAGCUCUGU | 2894 |
| CAGAGCUUAAAUCCUGCAU | 2895 | AUGCAGGAUUUAAGCUCUG | 2896 |
| AGAGCUUAAAUCCUGCAUA | 2897 | UAUGCAGGAUUUAAGCUCU | 2898 |
| GAGCUUAAAUCCUGCAUAA | 2899 | UUAUGCAGGAUUUAAGCUC | 2900 |

TABLE 4-continued

| Sense Sequence | SEQ ID NO: | Antisense Sequence | SEQ ID NO: |
|---|---|---|---|
| AGCUUAAAUCCUGCAUAAA | 2901 | UUUAUGCAGGAUUUAAGCU | 2902 |
| GCUUAAAUCCUGCAUAAAG | 2903 | CUUUAUGCAGGAUUUAAGC | 2904 |
| UAAAUCCUGCAUAAAGUAG | 2905 | CUACUUUAUGCAGGAUUUA | 2906 |
| AAAUCCUGCAUAAAGUAGC | 2907 | GCUACUUUAUGCAGGAUUU | 2908 |
| AAUCCUGCAUAAAGUAGCA | 2909 | UGCUACUUUAUGCAGGAUU | 2910 |
| GCAUAAAGUAGCAGCUCCA | 2911 | UGGAGCUGCUACUUUAUGC | 2912 |
| AAGUAGCAGCUCCAUGGCC | 2913 | GGCCAUGGAGCUGCUACUU | 2914 |
| AGUAGCAGCUCCAUGGCCC | 2915 | GGGCCAUGGAGCUGCUACU | 2916 |
| GUAGCAGCUCCAUGGCCCU | 2917 | AGGGCCAUGGAGCUGCUAC | 2918 |
| UAGCAGCUCCAUGGCCCUA | 2919 | UAGGGCCAUGGAGCUGCUA | 2920 |
| AGCAGCUCCAUGGCCCUAG | 2921 | CUAGGGCCAUGGAGCUGCU | 2922 |
| GCAGCUCCAUGGCCCUAGA | 2923 | UCUAGGGCCAUGGAGCUGC | 2924 |
| CAGCUCCAUGGCCCUAGAG | 2925 | CUCUAGGGCCAUGGAGCUG | 2926 |
| AGCUCCAUGGCCCUAGAGU | 2927 | ACUCUAGGGCCAUGGAGCU | 2928 |
| GCUCCAUGGCCCUAGAGUA | 2929 | UACUCUAGGGCCAUGGAGC | 2930 |
| UCCAUGGCCCUAGAGUAAA | 2931 | UUUACUCUAGGGCCAUGGA | 2932 |
| CCAUGGCCCUAGAGUAAAA | 2933 | UUUUACUCUAGGGCCAUGG | 2934 |
| AACUGGCCAGUCUGAUGCU | 2935 | AGCAUCAGACUGGCCAGUU | 2936 |
| CUGGCCAGUCUGAUGCUCU | 2937 | AGAGCAUCAGACUGGCCAG | 2938 |
| UGGCCAGUCUGAUGCUCUC | 2939 | GAGAGCAUCAGACUGGCCA | 2940 |
| GGCCAGUCUGAUGCUCUCA | 2941 | UGAGAGCAUCAGACUGGCC | 2942 |
| GCCAGUCUGAUGCUCUCAU | 2943 | AUGAGAGCAUCAGACUGGC | 2944 |
| CCAGUCUGAUGCUCUCAUU | 2945 | AAUGAGAGCAUCAGACUGG | 2946 |
| CAGUCUGAUGCUCUCAUUU | 2947 | AAAUGAGAGCAUCAGACUG | 2948 |
| AGGAAGGCCUCAAAGGUUC | 2949 | GAACCUUUGAGGCCUUCCU | 2950 |
| GGAAGGCCUCAAAGGUUCU | 2951 | AGAACCUUUGAGGCCUUCC | 2952 |
| GAAGGCCUCAAAGGUUCUU | 2953 | AAGAACCUUUGAGGCCUUC | 2954 |
| AAGGCCUCAAAGGUUCUUC | 2955 | GAAGAACCUUUGAGGCCUU | 2956 |
| AGGCCUCAAAGGUUCUUCU | 2957 | AGAAGAACCUUUGAGGCCU | 2958 |
| GGCCUCAAAGGUUCUUCUG | 2959 | CAGAAGAACCUUUGAGGCC | 2960 |
| GCCUCAAAGGUUCUUCUGA | 2961 | UCAGAAGAACCUUUGAGGC | 2962 |
| GGUUCUUCUGAGUGUUUUG | 2963 | CAAAACACUCAGAAGAACC | 2964 |
| GUUCUUCUGAGUGUUUUGA | 2965 | UCAAAACACUCAGAAGAAC | 2966 |
| UUCUGAGUGUUUUGAGGUG | 2967 | CACCUCAAAACACUCAGAA | 2968 |
| UCUGAGUGUUUUGAGGUGC | 2969 | GCACCUCAAAACACUCAGA | 2970 |
| AGUGUUUUGAGGUGCUAGC | 2971 | GCUAGCACCUCAAAACACU | 2972 |
| GUGUUUUGAGGUGCUAGCU | 2973 | AGCUAGCACCUCAAAACAC | 2974 |
| UGUUUUGAGGUGCUAGCUG | 2975 | CAGCUAGCACCUCAAAACA | 2976 |
| GUUUUGAGGUGCUAGCUGG | 2977 | CCAGCUAGCACCUCAAAAC | 2978 |
| UUUUGAGGUGCUAGCUGGA | 2979 | UCCAGCUAGCACCUCAAAA | 2980 |
| GAGGUGCUAGCUGGAUGGA | 2981 | UCCAUCCAGCUAGCACCUC | 2982 |
| AGGUGCUAGCUGGAUGGAA | 2983 | UUCCAUCCAGCUAGCACCU | 2984 |
| GUGCUAGCUGGAUGGAAGG | 2985 | CCUUCCAUCCAGCUAGCAC | 2986 |
| UGCUAGCUGGAUGGAAGGG | 2987 | CCCUUCCAUCCAGCUAGCA | 2988 |
| CUAUCUCCCUUAAUUAUGG | 2989 | CCAUAAUUAAGGGAGAUAG | 2990 |
| UAUCUCCCUUAAUUAUGGU | 2991 | ACCAUAAUUAAGGGAGAUA | 2992 |
| AUCUCCCUUAAUUAUGGUC | 2993 | GACCAUAAUUAAGGGAGAU | 2994 |
| UCUCCCUUAAUUAUGGUCU | 2995 | AGACCAUAAUUAAGGGAGA | 2996 |
| CUCCCUUAAUUAUGGUCUC | 2997 | GAGACCAUAAUUAAGGGAG | 2998 |
| CCCUUAAUUAUGGUCUCAG | 2999 | CUGAGACCAUAAUUAAGGG | 3000 |
| CCUUAAUUAUGGUCUCAGG | 3001 | CCUGAGACCAUAAUUAAGG | 3002 |
| CUUAAUUAUGGUCUCAGGU | 3003 | ACCUGAGACCAUAAUUAAG | 3004 |
| UUAAUUAUGGUCUCAGGUG | 3005 | CACCUGAGACCAUAAUUAA | 3006 |
| UAAUUAUGGUCUCAGGUGG | 3007 | CCACCUGAGACCAUAAUUA | 3008 |
| AAUUAUGGUCUCAGGUGGC | 3009 | GCCACCUGAGACCAUAAUU | 3010 |
| AUUAUGGUCUCAGGUGGCA | 3011 | UGCCACCUGAGACCAUAAU | 3012 |
| UUAUGGUCUCAGGUGGCAG | 3013 | CUGCCACCUGAGACCAUAA | 3014 |
| UAUGGUCUCAGGUGGCAGU | 3015 | ACUGCCACCUGAGACCAUA | 3016 |
| AUGGUCUCAGGUGGCAGUA | 3017 | UACUGCCACCUGAGACCAU | 3018 |
| UGGUCUCAGGUGGCAGUAG | 3019 | CUACUGCCACCUGAGACCA | 3020 |
| GGUCUCAGGUGGCAGUAGC | 3021 | GCUACUGCCACCUGAGACC | 3022 |
| GUCUCAGGUGGCAGUAGCC | 3023 | GGCUACUGCCACCUGAGAC | 3024 |
| CAGUAGCCACCAUCUCUGA | 3025 | UCAGAGAUGGUGGCUACUG | 3026 |
| AGUAGCCACCAUCUCUGAA | 3027 | UUCAGAGAUGGUGGCUACU | 3028 |
| UCACGACUGAUUUGUUAUA | 3029 | UAUAACAAAUCAGUCGUGA | 3030 |
| CACGACUGAUUUGUUAUAG | 3031 | CUAUAACAAAUCAGUCGUG | 3032 |
| CGACUGAUUUGUUAUAGUG | 3033 | CACUAUAACAAAUCAGUCG | 3034 |
| GACUGAUUUGUUAUAGUGG | 3035 | CCACUAUAACAAAUCAGUC | 3036 |
| GCGGCUGCUAAGAAGUCU | 3037 | AGACUUCUUAGACAGCCGC | 3038 |
| CGGCUGUCUAAGAAGUCUG | 3039 | CAGACUUCUUAGACAGCCG | 3040 |
| GGCUGUCUAAGAAGUCUGA | 3041 | UCAGACUUCUUAGACAGCC | 3042 |
| GCUGUCUAAGAAGUCUGAA | 3043 | UUCAGACUUCUUAGACAGC | 3044 |
| UCUAAGAAGUCUGAAUCUA | 3045 | UAGAUUCAGACUUCUUAGA | 3046 |
| CUAAGAAGUCUGAAUCUAU | 3047 | AUAGAUUCAGACUUCUUAG | 3048 |
| UAAGAAGUCUGAAUCUAUC | 3049 | GAUAGAUUCAGACUUCUUA | 3050 |
| AAGAAGUCUGAAUCUAUCU | 3051 | AGAUAGAUUCAGACUUCUU | 3052 |

TABLE 4-continued

| Sense Sequence | SEQ ID NO: | Antisense Sequence | SEQ ID NO: |
|---|---|---|---|
| AGAAGUCUGAAUCUAUCUG | 3053 | CAGAUAGAUUCAGACUUCU | 3054 |
| GAAGUCUGAAUCUAUCUGA | 3055 | UCAGAUAGAUUCAGACUUC | 3056 |
| AAGUCUGAAUCUAUCUGAC | 3057 | GUCAGAUAGAUUCAGACUU | 3058 |
| AGUCUGAAUCUAUCUGACA | 3059 | UGUCAGAUAGAUUCAGACU | 3060 |
| GUCUGAAUCUAUCUGACAG | 3061 | CUGUCAGAUAGAUUCAGAC | 3062 |
| UCUGAAUCUAUCUGACAGG | 3063 | CCUGUCAGAUAGAUUCAGA | 3064 |
| CUGAAUCUAUCUGACAGGA | 3065 | UCCUGUCAGAUAGAUUCAG | 3066 |
| UGAAUCUAUCUGACAGGAG | 3067 | CUCCUGUCAGAUAGAUUCA | 3068 |
| GAAUCUAUCUGACAGGAGU | 3069 | ACUCCUGUCAGAUAGAUUC | 3070 |
| AAUCUAUCUGACAGGAGUA | 3071 | UACUCCUGUCAGAUAGAUU | 3072 |
| AUCUAUCUGACAGGAGUAU | 3073 | AUACUCCUGUCAGAUAGAU | 3074 |
| UCUAUCUGACAGGAGUAUC | 3075 | GAUACUCCUGUCAGAUAGA | 3076 |
| CUAUCUGACAGGAGUAUCU | 3077 | AGAUACUCCUGUCAGAUAG | 3078 |
| UAUCUGACAGGAGUAUCUG | 3079 | CAGAUACUCCUGUCAGAUA | 3080 |
| CAGGAGUAUCUGUUACGUG | 3081 | CACGUAACAGAUACUCCUG | 3082 |
| AGGAGUAUCUGUUACGUGG | 3083 | CCACGUAACAGAUACUCCU | 3084 |
| GGAGUAUCUGUUACGUGGC | 3085 | GCCACGUAACAGAUACUCC | 3086 |
| GAGUAUCUGUUACGUGGCC | 3087 | GGCCACGUAACAGAUACUC | 3088 |
| AGUAUCUGUUACGUGGCCC | 3089 | GGGCCACGUAACAGAUACU | 3090 |
| GUAUCUGUUACGUGGCCCU | 3091 | AGGGCCACGUAACAGAUAC | 3092 |
| UAUCUGUUACGUGGCCCUC | 3093 | GAGGGCCACGUAACAGAUA | 3094 |
| AUCUGUUACGUGGCCCUCA | 3095 | UGAGGGCCACGUAACAGAU | 3096 |
| UCUGUUACGUGGCCCUCAU | 3097 | AUGAGGGCCACGUAACAGA | 3098 |
| CUGUUACGUGGCCCUCAUA | 3099 | UAUGAGGGCCACGUAACAG | 3100 |
| UGUUACGUGGCCCUCAUAC | 3101 | GUAUGAGGGCCACGUAACA | 3102 |
| CGUGGCCCUCAUACACUGU | 3103 | ACAGUGUAUGAGGGCCACG | 3104 |
| GUGGCCCUCAUACACUGUA | 3105 | UACAGUGUAUGAGGGCCAC | 3106 |
| UGGCCCUCAUACACUGUAA | 3107 | UUACAGUGUAUGAGGGCCA | 3108 |
| GGCCCUCAUACACUGUAAC | 3109 | GUUACAGUGUAUGAGGGCC | 3110 |
| ACAUUCUAGAAUUCAUGG | 3111 | CCAUGAAUUCUAGAAAUGU | 3112 |
| CAUUUCUAGAAUUCAUGGC | 3113 | GCCAUGAAUUCUAGAAAUG | 3114 |
| AUUUCUAGAAUUCAUGGCC | 3115 | GGCCAUGAAUUCUAGAAAU | 3116 |
| UUUCUAGAAUUCAUGGCCC | 3117 | GGGCCAUGAAUUCUAGAAA | 3118 |
| UUCUAGAAUUCAUGGCCCA | 3119 | UGGGCCAUGAAUUCUAGAA | 3120 |
| UCUAGAAUUCAUGGCCCAG | 3121 | CUGGGCCAUGAAUUCUAGA | 3122 |
| CUAGAAUUCAUGGCCCAGC | 3123 | GCUGGGCCAUGAAUUCUAG | 3124 |
| UAGAAUUCAUGGCCCAGCU | 3125 | AGCUGGGCCAUGAAUUCUA | 3126 |
| AGAAUUCAUGGCCCAGCUA | 3127 | UAGCUGGGCCAUGAAUUCU | 3128 |
| GAAUUCAUGGCCCAGCUAU | 3129 | AUAGCUGGGCCAUGAAUUC | 3130 |
| AAUUCAUGGCCCAGCUAUA | 3131 | UAUAGCUGGGCCAUGAAUU | 3132 |
| AUUCAUGGCCCAGCUAUAG | 3133 | CUAUAGCUGGGCCAUGAAU | 3134 |
| UUCAUGGCCCAGCUAUAGC | 3135 | GCUAUAGCUGGGCCAUGAA | 3136 |
| UCAUGGCCCAGCUAUAGCA | 3137 | UGCUAUAGCUGGGCCAUGA | 3138 |
| CAUGGCCCAGCUAUAGCAG | 3139 | CUGCUAUAGCUGGGCCAUG | 3140 |
| AUGGCCCAGCUAUAGCAGA | 3141 | UCUGCUAUAGCUGGGCCAU | 3142 |
| CCCAGCUAUAGCAGAAUAA | 3143 | UUAUUCUGCUAUAGCUGGG | 3144 |
| AACGUCCCACUAAUGCUAU | 3145 | AUAGCAUUAGUGGGACGUU | 3146 |
| ACGUCCCACUAAUGCUAUC | 3147 | GAUAGCAUUAGUGGGACGU | 3148 |
| CGUCCCACUAAUGCUAUCC | 3149 | GGAUAGCAUUAGUGGGACG | 3150 |
| CCACUAAUGCUAUCCAGGU | 3151 | ACCUGGAUAGCAUUAGUGG | 3152 |
| CACUAAUGCUAUCCAGGUG | 3153 | CACCUGGAUAGCAUUAGUG | 3154 |
| ACUAAUGCUAUCCAGGUGA | 3155 | UCACCUGGAUAGCAUUAGU | 3156 |
| CUAAUGCUAUCCAGGUGAA | 3157 | UUCACCUGGAUAGCAUUAG | 3158 |
| UAAUGCUAUCCAGGUGAAG | 3159 | CUUCACCUGGAUAGCAUUA | 3160 |
| AUCCAGGUGAAGGGCUUCC | 3161 | GGAAGCCCUUCACCUGGAU | 3162 |
| CCUCUGCUCCACCGCUAGU | 3163 | ACUAGCGGUGGAGCAGAGG | 3164 |
| CUCUGCUCCACCGCUAGUA | 3165 | UACUAGCGGUGGAGCAGAG | 3166 |
| UCUGCUCCACCGCUAGUAA | 3167 | UUACUAGCGGUGGAGCAGA | 3168 |
| CUGCUCCACCGCUAGUAAA | 3169 | UUUACUAGCGGUGGAGCAG | 3170 |
| UGCUCCACCGCUAGUAAAG | 3171 | CUUUACUAGCGGUGGAGCA | 3172 |
| GCUCCACCGCUAGUAAAGC | 3173 | GCUUUACUAGCGGUGGAGC | 3174 |
| CUCCACCGCUAGUAAAGCC | 3175 | GGCUUUACUAGCGGUGGAG | 3176 |
| UCCACCGCUAGUAAAGCCA | 3177 | UGGCUUUACUAGCGGUGGA | 3178 |
| CCACCGCUAGUAAAGCCAA | 3179 | UUGGCUUUACUAGCGGUGG | 3180 |
| CACCGCUAGUAAAGCCAAA | 3181 | UUUGGCUUUACUAGCGGUG | 3182 |
| ACCGCUAGUAAAGCCAAAA | 3183 | UUUUGGCUUUACUAGCGGU | 3184 |
| CCGCUAGUAAAGCCAAAAU | 3185 | AUUUUGGCUUUACUAGCGG | 3186 |
| CGCUAGUAAAGCCAAAAUA | 3187 | UAUUUUGGCUUUACUAGCG | 3188 |
| GCUAGUAAAGCCAAAAUAC | 3189 | GUAUUUUGGCUUUACUAGC | 3190 |
| CUAGUAAAGCCAAAAUACA | 3191 | UGUAUUUUGGCUUUACUAG | 3192 |
| AUACCACCUCUCCCAAAU | 3193 | AUUUGGGAGAGGUGGAUAU | 3194 |
| UAUCCACCUCUCCCAAAUG | 3195 | CAUUUGGGAGAGGUGGAUA | 3196 |
| UCUCCCAAAUGCAGACACU | 3197 | AGUGUCUGCAUUUGGGAGA | 3198 |
| CUCCCAAAUGCAGACACUG | 3199 | CAGUGUCUGCAUUUGGGAG | 3200 |
| UCCCAAAUGCAGACACUGA | 3201 | UCAGUGUCUGCAUUUGGGA | 3202 |
| CCCAAAUGCAGACACUGAU | 3203 | AUCAGUGUCUGCAUUUGGG | 3204 |

TABLE 4-continued

| Sense Sequence | SEQ ID NO: | Antisense Sequence | SEQ ID NO: |
|---|---|---|---|
| CAAAUGCAGACACUGAUGG | 3205 | CCAUCAGUGUCUGCAUUUG | 3206 |
| AAAUGCAGACACUGAUGGG | 3207 | CCCAUCAGUGUCUGCAUUU | 3208 |
| AAUGCAGACACUGAUGGGU | 3209 | ACCCAUCAGUGUCUGCAUU | 3210 |
| AUGCAGACACUGAUGGGUA | 3211 | UACCCAUCAGUGUCUGCAU | 3212 |
| UGCAGACACUGAUGGGUAA | 3213 | UUACCCAUCAGUGUCUGCA | 3214 |
| GCAGACACUGAUGGGUAAU | 3215 | AUUACCCAUCAGUGUCUGC | 3216 |
| CAGACACUGAUGGGUAAUU | 3217 | AAUUACCCAUCAGUGUCUG | 3218 |
| AGACACUGAUGGGUAAUUA | 3219 | UAAUUACCCAUCAGUGUCU | 3220 |
| GACACUGAUGGGUAAUUAA | 3221 | UUAAUUACCCAUCAGUGUC | 3222 |
| ACACUGAUGGGUAAUUAAC | 3223 | GUUAAUUACCCAUCAGUGU | 3224 |
| AUAAAGGCUCAGUCUCUAA | 3225 | UUAGAGACUGAGCCUUUAU | 3226 |
| UAAAGGCUCAGUCUCUAAA | 3227 | UUUAGAGACUGAGCCUUUA | 3228 |
| CUCAACUCAGAUGGAGCCA | 3229 | UGGCUCCAUCUGAGUUGAG | 3230 |
| UCAACUCAGAUGGAGCCAC | 3231 | GUGGCUCCAUCUGAGUUGA | 3232 |
| CAACUCAGAUGGAGCCACU | 3233 | AGUGGCUCCAUCUGAGUUG | 3234 |
| AGAUGGAGCCACUGGGUCU | 3235 | AGACCCAGUGGCUCCAUCU | 3236 |
| GAUGGAGCCACUGGGUCUA | 3237 | UAGACCCAGUGGCUCCAUC | 3238 |
| AUGGAGCCACUGGGUCUAA | 3239 | UUAGACCCAGUGGCUCCAU | 3240 |
| UGGAGCCACUGGGUCUAAA | 3241 | UUUAGACCCAGUGGCUCCA | 3242 |
| GGAGCCACUGGGUCUAAAU | 3243 | AUUUAGACCCAGUGGCUCC | 3244 |
| GAGCCACUGGGUCUAAAUG | 3245 | CAUUUAGACCCAGUGGCUC | 3246 |
| AGCCACUGGGUCUAAAUGC | 3247 | GCAUUUAGACCCAGUGGCU | 3248 |
| GCCACUGGGUCUAAAUGCU | 3249 | AGCAUUUAGACCCAGUGGC | 3250 |
| CCACUGGGUCUAAAUGCUC | 3251 | GAGCAUUUAGACCCAGUGG | 3252 |
| CACUGGGUCUAAAUGCUCA | 3253 | UGAGCAUUUAGACCCAGUG | 3254 |
| ACUGGGUCUAAAUGCUCAC | 3255 | GUGAGCAUUUAGACCCAGU | 3256 |
| CUGGGUCUAAAUGCUCACC | 3257 | GGUGAGCAUUUAGACCCAG | 3258 |
| GGUCUAAAUGCUCACCCUG | 3259 | CAGGGUGAGCAUUUAGACC | 3260 |
| GUCUAAAUGCUCACCCUGU | 3261 | ACAGGGUGAGCAUUUAGAC | 3262 |
| UCUAAAUGCUCACCCUGUG | 3263 | CACAGGGUGAGCAUUUAGA | 3264 |
| CUAAAUGCUCACCCUGUGG | 3265 | CCACAGGGUGAGCAUUUAG | 3266 |
| GAUGCCAUCUACGACUGCU | 3267 | AGCAGUCGUAGAUGGCAUC | 3268 |
| AUGCCAUCUACGACUGCUC | 3269 | GAGCAGUCGUAGAUGGCAU | 3270 |
| UGCCAUCUACGACUGCUCU | 3271 | AGAGCAGUCGUAGAUGGCA | 3272 |
| GCCAUCUACGACUGCUCUU | 3273 | AAGAGCAGUCGUAGAUGGC | 3274 |
| CCAUCUACGACUGCUCUUC | 3275 | GAAGAGCAGUCGUAGAUGG | 3276 |
| CUACGACUGCUCUUCCCUC | 3277 | GAGGGAAGAGCAGUCGUAG | 3278 |
| UACGACUGCUCUUCCCUCU | 3279 | AGAGGGAAGAGCAGUCGUA | 3280 |
| AUCUCUGGAGUGUAUAAGC | 3281 | GCUUAUACACUCCAGAGAU | 3282 |
| CUGGAGUGUAUAAGCUUCC | 3283 | GGAAGCUUAUACACUCCAG | 3284 |
| UGGAGUGUAUAAGCUUCCU | 3285 | AGGAAGCUUAUACACUCCA | 3286 |
| GGAGUGUAUAAGCUUCCUC | 3287 | GAGGAAGCUUAUACACUCC | 3288 |
| GUAUAAGCUUCCUCCUGAU | 3289 | AUCAGGAGGAAGCUUAUAC | 3290 |
| UAUAAGCUUCCUCCUGAUG | 3291 | CAUCAGGAGGAAGCUUAUA | 3292 |
| AUAAGCUUCCUCCUGAUGA | 3293 | UCAUCAGGAGGAAGCUUAU | 3294 |
| AAGCUUCCUCCUGAUGACU | 3295 | AGUCAUCAGGAGGAAGCUU | 3296 |
| AGCUUCCUCCUGAUGACUU | 3297 | AAGUCAUCAGGAGGAAGCU | 3298 |
| GCUUCCUCCUGAUGACUUC | 3299 | GAAGUCAUCAGGAGGAAGC | 3300 |
| CUUCCUCCUGAUGACUUCC | 3301 | GGAAGUCAUCAGGAGGAAG | 3302 |
| UUCCUCCUGAUGACUUCCU | 3303 | AGGAAGUCAUCAGGAGGAA | 3304 |
| ACUUCCUGGGCAGCCCUGA | 3305 | UCAGGGCUGCCCAGGAAGU | 3306 |
| ACUGGAGGUGAGGUCAUUA | 3307 | UAAUGACCUCACCUCCAGU | 3308 |
| CUGGAGGUGAGGUCAUUAC | 3309 | GUAAUGACCUCACCUCCAG | 3310 |
| UGGAGGUGAGGUCAUUACA | 3311 | UGUAAUGACCUCACCUCCA | 3312 |
| GGAGGUGAGGUCAUUACAG | 3313 | CUGUAAUGACCUCACCUCC | 3314 |
| GAGGUGAGGUCAUUACAGU | 3315 | ACUGUAAUGACCUCACCUC | 3316 |
| AGGUGAGGUCAUUACAGUC | 3317 | GACUGUAAUGACCUCACCU | 3318 |
| GGUGAGGUCAUUACAGUCA | 3319 | UGACUGUAAUGACCUCACC | 3320 |
| UCAUUACAGUCACUGGCCA | 3321 | UGGCCAGUGACUGUAAUGA | 3322 |
| CAUUACAGUCACUGGCCAU | 3323 | AUGGCCAGUGACUGUAAUG | 3324 |
| AUUACAGUCACUGGCCAUG | 3325 | CAUGGCCAGUGACUGUAAU | 3326 |
| UACAGUCACUGGCCAUGCC | 3327 | GGCAUGGCCAGUGACUGUA | 3328 |
| ACAGUCACUGGCCAUGCCC | 3329 | GGGCAUGGCCAGUGACUGU | 3330 |
| CAGUCACUGGCCAUGCCCU | 3331 | AGGGCAUGGCCAGUGACUG | 3332 |
| GUCACUGGCCAUGCCCUAA | 3333 | UUAGGGCAUGGCCAGUGAC | 3334 |
| UCACUGGCCAUGCCCUAAU | 3335 | AUUAGGGCAUGGCCAGUGA | 3336 |
| CACUGGCCAUGCCCUAAUA | 3337 | UAUUAGGGCAUGGCCAGUG | 3338 |
| ACUGGCCAUGCCCUAAUAC | 3339 | GUAUUAGGGCAUGGCCAGU | 3340 |
| CUGGCCAUGCCCUAAUACC | 3341 | GGUAUUAGGGCAUGGCCAG | 3342 |
| UGGCCAUGCCCUAAUACCU | 3343 | AGGUAUUAGGGCAUGGCCA | 3344 |
| GCCAUGCCCUAAUACCUGU | 3345 | ACAGGUAUUAGGGCAUGGC | 3346 |
| CCAUGCCCUAAUACCUGUC | 3347 | GACAGGUAUUAGGGCAUGG | 3348 |
| CAUGCCCUAAUACCUGUCC | 3349 | GGACAGGUAUUAGGGCAUG | 3350 |
| AUGCCCUAAUACCUGUCCU | 3351 | AGGACAGGUAUUAGGGCAU | 3352 |
| UGCCCUAAUACCUGUCCUU | 3353 | AAGGACAGGUAUUAGGGCA | 3354 |
| GCCCUAAUACCUGUCCUUC | 3355 | GAAGGACAGGUAUUAGGGC | 3356 |

TABLE 4-continued

| Sense Sequence | SEQ ID NO: | Antisense Sequence | SEQ ID NO: |
|---|---|---|---|
| CCCUAAUACCUGUCCUUCA | 3357 | UGAAGGACAGGUAUUAGGG | 3358 |
| CUAAUACCUGUCCUUCACC | 3359 | GGUGAAGGACAGGUAUUAG | 3360 |
| UAAUACCUGUCCUUCACCC | 3361 | GGGUGAAGGACAGGUAUUA | 3362 |
| ACAGGGCCAUUCACAGUUU | 3363 | AAACUGUGAAUGGCCCUGU | 3364 |
| CAGGGCCAUUCACAGUUUA | 3365 | UAAACUGUGAAUGGCCCUG | 3366 |
| AGGGCCAUUCACAGUUUAA | 3367 | UUAAACUGUGAAUGGCCCU | 3368 |
| GGGCCAUUCACAGUUUAAA | 3369 | UUUAAACUGUGAAUGGCCC | 3370 |
| GGCCAUUCACAGUUUAAAG | 3371 | CUUUAAACUGUGAAUGGCC | 3372 |
| CCAUUCACAGUUUAAAGAA | 3373 | UUCUUUAAACUGUGAAUGG | 3374 |
| CUGUAAUCCCAGCACUAUG | 3375 | CAUAGUGCUGGGAUUACAG | 3376 |
| UGUAAUCCCAGCACUAUGG | 3377 | CCAUAGUGCUGGGAUUACA | 3378 |
| ACUAUGGGAGGCCGAGGCA | 3379 | UGCCUCGGCCUCCCAUAGU | 3380 |
| CCGAGGCAGGUGGAUCACU | 3381 | AGUGAUCCACCUGCCUCGG | 3382 |
| CGAGGCAGGUGGAUCACUU | 3383 | AAGUGAUCCACCUGCCUCG | 3384 |
| GAGGCAGGUGGAUCACUUC | 3385 | GAAGUGAUCCACCUGCCUC | 3386 |
| AGGCAGGUGGAUCACUUCA | 3387 | UGAAGUGAUCCACCUGCCU | 3388 |
| GGCAGGUGGAUCACUUCAG | 3389 | CUGAAGUGAUCCACCUGCC | 3390 |
| GCAGGUGGAUCACUUCAGG | 3391 | CCUGAAGUGAUCCACCUGC | 3392 |
| CAGGUGGAUCACUUCAGGU | 3393 | ACCUGAAGUGAUCCACCUG | 3394 |
| GUUUAAGACCAGCCUGGCC | 3395 | GGCCAGGCUGGUCUUAAAC | 3396 |
| UUUAAGACCAGCCUGGCCA | 3397 | UGGCCAGGCUGGUCUUAAA | 3398 |
| UUAAGACCAGCCUGGCCAA | 3399 | UUGGCCAGGCUGGUCUUAA | 3400 |
| UAAGACCAGCCUGGCCAAC | 3401 | GUUGGCCAGGCUGGUCUUA | 3402 |
| AAAAUUAGCCAGGCAUGGU | 3403 | ACCAUGCCUGGCUAAUUUU | 3404 |
| AAAUUAGCCAGGCAUGGUG | 3405 | CACCAUGCCUGGCUAAUUU | 3406 |
| AAUUAGCCAGGCAUGGUGG | 3407 | CCACCAUGCCUGGCUAAUU | 3408 |
| AUUAGCCAGGCAUGGUGGU | 3409 | ACCACCAUGCCUGGCUAAU | 3410 |
| UUAGCCAGGCAUGGUGGUG | 3411 | CACCACCAUGCCUGGCUAA | 3412 |
| UAGCCAGGCAUGGUGGUGG | 3413 | CCACCACCAUGCCUGGCUA | 3414 |
| AACUCAGGAGGCAGAGGUU | 3415 | AACCUCUGCCUCCUGAGUU | 3416 |
| ACUCAGGAGGCAGAGGUUG | 3417 | CAACCUCUGCCUCCUGAGU | 3418 |
| CUCAGGAGGCAGAGGUUGC | 3419 | GCAACCUCUGCCUCCUGAG | 3420 |
| UCAGGAGGCAGAGGUUGCA | 3421 | UGCAACCUCUGCCUCCUGA | 3422 |
| CAGGAGGCAGAGGUUGCAG | 3423 | CUGCAACCUCUGCCUCCUG | 3424 |
| GAGGUUGCAGUGAGCCGAG | 3425 | CUCGGCUCACUGCAACCUC | 3426 |
| AUCACGCCACUGCACUAUA | 3427 | UAUAGUGCAGUGGCGUGAU | 3428 |
| UCACGCCACUGCACUAUAA | 3429 | UUAUAGUGCAGUGGCGUGA | 3430 |
| CACGCCACUGCACUAUAAU | 3431 | AUUAUAGUGCAGUGGCGUG | 3432 |
| ACGCCACUGCACUAUAAUC | 3433 | GAUUAUAGUGCAGUGGCGU | 3434 |
| CGCCACUGCACUAUAAUCU | 3435 | AGAUUAUAGUGCAGUGGCG | 3436 |
| GCCACUGCACUAUAAUCUG | 3437 | CAGAUUAUAGUGCAGUGGC | 3438 |
| ACCCAGGCAUCUGUUUGGC | 3439 | GCCAAACAGAUGCCUGGGU | 3440 |
| CCCAGGCAUCUGUUUGGCC | 3441 | GGCCAAACAGAUGCCUGGG | 3442 |
| CCAGGCAUCUGUUUGGCCC | 3443 | GGGCCAAACAGAUGCCUGG | 3444 |
| CCCUUCAAAUCAUUAUCAG | 3445 | CUGAUAAUGAUUUGAAGGG | 3446 |
| CCUUCAAAUCAUUAUCAGU | 3447 | ACUGAUAAUGAUUUGAAGG | 3448 |
| CUUCAAAUCAUUAUCAGUC | 3449 | GACUGAUAAUGAUUUGAAG | 3450 |
| ACAUAGAUCAGAUCAUUCU | 3451 | AGAAUGAUCUGAUCUAUGU | 3452 |
| CAUAGAUCAGAUCAUUCUU | 3453 | AAGAAUGAUCUGAUCUAUG | 3454 |
| UCAGAUCAUUCUUAUAACC | 3455 | GGUUAUAAGAAUGAUCUGA | 3456 |
| CAGAUCAUUCUUAUAACCA | 3457 | UGGUUAUAAGAAUGAUCUG | 3458 |
| AUAACCACCACAUAACUUA | 3459 | UAAGUUAUGUGGUGGUUAU | 3460 |
| UAACCACCACAUAACUUAG | 3461 | CUAAGUUAUGUGGUGGUUA | 3462 |
| AACCACCACAUAACUUAGU | 3463 | ACUAAGUUAUGUGGUGGUU | 3464 |
| ACCACCACAUAACUUAGUU | 3465 | AACUAAGUUAUGUGGUGGU | 3466 |
| CCACCACAUAACUUAGUUU | 3467 | AAACUAAGUUAUGUGGUGG | 3468 |
| CACCACAUAACUUAGUUUA | 3469 | UAAACUAAGUUAUGUGGUG | 3470 |
| ACACGAAGGCAGCAUCAAA | 3471 | UUUGAUGCUGCCUUCGUGU | 3472 |
| CACGAAGGCAGCAUCAAAU | 3473 | AUUUGAUGCUGCCUUCGUG | 3474 |
| ACGAAGGCAGCAUCAAAUU | 3475 | AAUUUGAUGCUGCCUUCGU | 3476 |
| CGAAGGCAGCAUCAAAUUA | 3477 | UAAUUUGAUGCUGCCUUCG | 3478 |
| GAAGGCAGCAUCAAAUUAU | 3479 | AUAAUUUGAUGCUGCCUUC | 3480 |
| AAGGCAGCAUCAAAUUAUC | 3481 | GAUAAUUUGAUGCUGCCUU | 3482 |
| AGGCAGCAUCAAAUUAUCU | 3483 | AGAUAAUUUGAUGCUGCCU | 3484 |
| GGCAGCAUCAAAUUAUCUG | 3485 | CAGAUAAUUUGAUGCUGCC | 3486 |
| AAUUAUCUGGAUUUUCACC | 3487 | GGUGAAAAUCCAGAUAAUU | 3488 |
| AUUAUCUGGAUUUUCACCC | 3489 | GGGUGAAAAUCCAGAUAAU | 3490 |
| UUAUCUGGAUUUUCACCCA | 3491 | UGGGUGAAAAUCCAGAUAA | 3492 |
| AUUUUCACCCAGGCAUGGU | 3493 | ACCAUGCCUGGGUGAAAAU | 3494 |
| ACCCAGGCAUGGUGGCUCA | 3495 | UGAGCCACCAUGCCUGGGU | 3496 |
| CCAGGCAUGGUGGCUCACA | 3497 | UGUGAGCCACCAUGCCUGG | 3498 |
| CAGGCAUGGUGGCUCACAC | 3499 | GUGUGAGCCACCAUGCCUG | 3500 |
| GUGGCUCACACCUGUAAUC | 3501 | GAUUACAGGUGUGAGCCAC | 3502 |
| UGGCUCACACCUGUAAUCC | 3503 | GGAUUACAGGUGUGAGCCA | 3504 |
| GGCUCACACCUGUAAUCCC | 3505 | GGGAUUACAGGUGUGAGCC | 3506 |
| CACACCUGUAAUCCCAAGU | 3507 | ACUUGGGAUUACAGGUGUG | 3508 |

TABLE 4-continued

| Sense Sequence | SEQ ID NO: | Antisense Sequence | SEQ ID NO: |
|---|---|---|---|
| ACACCUGUAAUCCCAAGUU | 3509 | AACUUGGGAUUACAGGUGU | 3510 |
| CACCUGUAAUCCCAAGUUU | 3511 | AAACUUGGGAUUACAGGUG | 3512 |
| ACCUGUAAUCCCAAGUUUU | 3513 | AAAACUUGGGAUUACAGGU | 3514 |
| GGCACUCUGGUCCCAGCUA | 3515 | UAGCUGGGACCAGAGUGCC | 3516 |
| GCACUCUGGUCCCAGCUAC | 3517 | GUAGCUGGGACCAGAGUGC | 3518 |
| CACUCUGGUCCCAGCUACU | 3519 | AGUAGCUGGGACCAGAGUG | 3520 |
| ACUCUGGUCCCAGCUACUA | 3521 | UAGUAGCUGGGACCAGAGU | 3522 |
| AACUCAGGAGGUGGAGGUU | 3523 | AACCUCCACCUCCUGAGUU | 3524 |
| ACUCAGGAGGUGGAGGUUG | 3525 | CAACCUCCACCUCCUGAGU | 3526 |
| CUCAGGAGGUGGAGGUUGC | 3527 | GCAACCUCCACCUCCUGAG | 3528 |
| UCAGGAGGUGGAGGUUGCA | 3529 | UGCAACCUCCACCUCCUGA | 3530 |
| CAGGAGGUGGAGGUUGCAG | 3531 | CUGCAACCUCCACCUCCUG | 3532 |
| GAGGUUGCAGUGAGCCGAG | 3533 | CUCGGCUCACUGCAACCUC | 3534 |
| AGAUUGCACCACUGUACUC | 3535 | GAGUACAGUGGUGCAAUCU | 3536 |
| ACUGUACUCUAGCCUGGGC | 3537 | GCCCAGGCUAGAGUACAGU | 3538 |
| CUGUACUCUAGCCUGGGCA | 3539 | UGCCCAGGCUAGAGUACAG | 3540 |
| UGUACUCUAGCCUGGGCAA | 3541 | UUGCCCAGGCUAGAGUACA | 3542 |
| UCCCUCCAAGCUUCAUGUG | 3543 | CACAUGAAGCUUGGAGGGA | 3544 |
| CCCUCCAAGCUUCAUGUGC | 3545 | GCACAUGAAGCUUGGAGGG | 3546 |
| CCUCCAAGCUUCAUGUGCA | 3547 | UGCACAUGAAGCUUGGAGG | 3548 |
| CUCCAAGCUUCAUGUGCAC | 3549 | GUGCACAUGAAGCUUGGAG | 3550 |
| GGCCCAAUUUGCAUCGUUC | 3551 | GAACGAUGCAAAUUGGGCC | 3552 |
| GCCCAAUUUGCAUCGUUCU | 3553 | AGAACGAUGCAAAUUGGGC | 3554 |
| CCCAAUUUGCAUCGUUCUU | 3555 | AAGAACGAUGCAAAUUGGG | 3556 |
| CCAAUUUGCAUCGUUCUUC | 3557 | GAAGAACGAUGCAAAUUGG | 3558 |
| UUUGCAUCGUUCUUCCAGA | 3559 | UCUGGAAGAACGAUGCAAA | 3560 |
| CAUCGUUCUUCCAGAGCAA | 3561 | UUGCUCUGGAAGAACGAUG | 3562 |
| AUCGUUCUUCCAGAGCAAU | 3563 | AUUGCUCUGGAAGAACGAU | 3564 |
| UCGUUCUUCCAGAGCAAUG | 3565 | CAUUGCUCUGGAAGAACGA | 3566 |
| CGUUCUUCCAGAGCAAUGC | 3567 | GCAUUGCUCUGGAAGAACG | 3568 |
| CUUCCAGAGCAAUGCACCA | 3569 | UGGUGCAUUGCUCUGGAAG | 3570 |
| UUCCAGAGCAAUGCACCAC | 3571 | GUGGUGCAUUGCUCUGGAA | 3572 |
| CCCGAGUGAGCCAGUGUGA | 3573 | UCACACUGGCUCACUCGGG | 3574 |
| CCGAGUGAGCCAGUGUGAC | 3575 | GUCACACUGGCUCACUCGG | 3576 |
| CGAGUGAGCCAGUGUGACU | 3577 | AGUCACACUGGCUCACUCG | 3578 |
| AGUGUGACUGCGGGAGUGC | 3579 | GCACUCCCGCAGUCACACU | 3580 |
| GUGUGACUGCGGGAGUGCA | 3581 | UGCACUCCCGCAGUCACAC | 3582 |
| UGUGACUGCGGGAGUGCAC | 3583 | GUGCACUCCCGCAGUCACA | 3584 |
| GUGACUGCGGGAGUGCACA | 3585 | UGUGCACUCCCGCAGUCAC | 3586 |
| UGACUGCGGGAGUGCACAC | 3587 | GUGUGCACUCCCGCAGUCA | 3588 |
| UCUACUGGCUCUGCAGGGA | 3589 | UCCCUGCAGAGCCAGUAGA | 3590 |
| UACUGGCUCUGCAGGGACA | 3591 | UGUCCCUGCAGAGCCAGUA | 3592 |
| AGGUUGGGAAGCCUGCCCU | 3593 | AGGGCAGGCUUCCCAACCU | 3594 |
| GUUGGGAAGCCUGCCCUCU | 3595 | AGAGGGCAGGCUUCCCAAC | 3596 |
| UUGGGAAGCCUGCCCUCUU | 3597 | AAGAGGGCAGGCUUCCCAA | 3598 |
| GAAGCCUGCCCUCUUGCUC | 3599 | GAGCAAGAGGGCAGGCUUC | 3600 |
| AAGCCUGCCCUCUUGCUCC | 3601 | GGAGCAAGAGGGCAGGCUU | 3602 |
| CUCUUGCUCCUGCCUUCUG | 3603 | CAGAAGGCAGGAGCAAGAG | 3604 |
| UCUUGCUCCUGCCUUCUGC | 3605 | GCAGAAGGCAGGAGCAAGA | 3606 |
| UUGCUCCUGCCUUCUGCCC | 3607 | GGGCAGAAGGCAGGAGCAA | 3608 |
| CCCUGCAAGUCCCUCACCA | 3609 | UGGUGAGGGACUUGCAGGG | 3610 |
| CCUGCAAGUCCCUCACCAG | 3611 | CUGGUGAGGGACUUGCAGG | 3612 |
| AAGUCCCUCACCAGAGUAU | 3613 | AUACUCUGGUGAGGGACUU | 3614 |
| AGUCCCUCACCAGAGUAUC | 3615 | GAUACUCUGGUGAGGGACU | 3616 |
| GUCCCUCACCAGAGUAUCC | 3617 | GGAUACUCUGGUGAGGGAC | 3618 |
| UCCCUCACCAGAGUAUCCC | 3619 | GGGAUACUCUGGUGAGGGA | 3620 |
| CCCUCUGCUUCAGGUGUUC | 3621 | GAACACCUGAAGCAGAGGG | 3622 |
| CCUCUGCUUCAGGUGUUCU | 3623 | AGAACACCUGAAGCAGAGG | 3624 |
| CUCUGCUUCAGGUGUUCUG | 3625 | CAGAACACCUGAAGCAGAG | 3626 |
| AGACUUCAGGCGGAGGCUG | 3627 | CAGCCUCCGCCUGAAGUCU | 3628 |
| ACUUCAGGCGGAGGCUGGA | 3629 | UCCAGCCUCCGCCUGAAGU | 3630 |
| GCGGAGGCUGGACCAUCAU | 3631 | AUGAUGGUCCAGCCUCCGC | 3632 |
| CGGAGGCUGGACCAUCAUC | 3633 | GAUGAUGGUCCAGCCUCCG | 3634 |
| GGAGGCUGGACCAUCAUCC | 3635 | GGAUGAUGGUCCAGCCUCC | 3636 |
| AAGUGGCCUUGUCUCCUUC | 3637 | GAAGGAGACAAGGCCACUU | 3638 |
| AGUGGCCUUGUCUCCUUCU | 3639 | AGAAGGAGACAAGGCCACU | 3640 |
| GUGGCCUUGUCUCCUUCUA | 3641 | UAGAAGGAGACAAGGCCAC | 3642 |
| CUUGUCUCCUUCUACCGGG | 3643 | CCCGGUAGAAGGAGACAAG | 3644 |
| UUGUCUCCUUCUACCGGGA | 3645 | UCCCGGUAGAAGGAGACAA | 3646 |
| UGUCUCCUUCUACCGGGAC | 3647 | GUCCCGGUAGAAGGAGACA | 3648 |
| GUCUCCUUCUACCGGGACU | 3649 | AGUCCCGGUAGAAGGAGAC | 3650 |
| UUCUACCGGGACUGGAAGC | 3651 | GCUUCCAGUCCCGGUAGAA | 3652 |
| UCUACCGGGACUGGAAGCA | 3653 | UGCUUCCAGUCCCGGUAGA | 3654 |
| CUACCGGGACUGGAAGCAG | 3655 | CUGCUUCCAGUCCCGGUAG | 3656 |
| AGCAGGGCUUUGGCAGCAU | 3657 | AUGCUGCCAAAGCCCUGCU | 3658 |
| AGGGCUUUGGCAGCAUCCG | 3659 | CGGAUGCUGCCAAAGCCCU | 3660 |

TABLE 4-continued

| Sense Sequence | SEQ ID NO: | Antisense Sequence | SEQ ID NO: |
|---|---|---|---|
| GGGCUUUGGCAGCAUCCGU | 3661 | ACGGAUGCUGCCAAAGCCC | 3662 |
| GGCUUUGGCAGCAUCCGUG | 3663 | CACGGAUGCUGCCAAAGCC | 3664 |
| CAUCCACCGGCUCUCCAGA | 3665 | UCUGGAGAGCCGGUGGAUG | 3666 |
| AUCCACCGGCUCUCCAGAC | 3667 | GUCUGGAGAGCCGGUGGAU | 3668 |
| UCCACCGGCUCUCCAGACA | 3669 | UGUCUGGAGAGCCGGUGGA | 3670 |
| CUGGACCAGUGCCACCACA | 3671 | UGUGGUGGCACUGGUCCAG | 3672 |
| GGGUGCCAUUCCUAUUCUG | 3673 | CAGAAUAGGAAUGGCACCC | 3674 |
| GGUGCCAUUCCUAUUCUGA | 3675 | UCAGAAUAGGAAUGGCACC | 3676 |
| GUGCCAUUCCUAUUCUGAU | 3677 | AUCAGAAUAGGAAUGGCAC | 3678 |
| UGCCAUUCCUAUUCUGAUU | 3679 | AAUCAGAAUAGGAAUGGCA | 3680 |
| AUUCCUAUUCUGAUUCAAG | 3681 | CUUGAAUCAGAAUAGGAAU | 3682 |
| UGUAUAUUCAUUGUGAUGG | 3683 | CCAUCACAAUGAAUAUACA | 3684 |
| GUAUAUUCAUUGUGAUGGU | 3685 | ACCAUCACAAUGAAUAUAC | 3686 |
| AUUCAUUGUGAUGGUUUUC | 3687 | GAAAACCAUCACAAUGAAU | 3688 |
| UUCAUUGUGAUGGUUUUCC | 3689 | GGAAAACCAUCACAAUGAA | 3690 |
| UGUGAUGGUUUUCCUGCAA | 3691 | UUGCAGGAAAACCAUCACA | 3692 |
| GUGAUGGUUUUCCUGCAAG | 3693 | CUUGCAGGAAAACCAUCAC | 3694 |
| UGAUGGUUUUCCUGCAAGU | 3695 | ACUUGCAGGAAAACCAUCA | 3696 |
| AUGGUUUUCCUGCAAGUUG | 3697 | CAACUUGCAGGAAAACCAU | 3698 |
| GGUUUUCCUGCAAGUUGUA | 3699 | UACAACUUGCAGGAAAACC | 3700 |
| GUUUUCCUGCAAGUUGUAA | 3701 | UUACAACUUGCAGGAAAAC | 3702 |
| UUUUCCUGCAAGUUGUAAU | 3703 | AUUACAACUUGCAGGAAAA | 3704 |
| UUUCCUGCAAGUUGUAAUG | 3705 | CAUUACAACUUGCAGGAAA | 3706 |
| UUCCUGCAAGUUGUAAUGG | 3707 | CCAUUACAACUUGCAGGAA | 3708 |
| UCCUGCAAGUUGUAAUGGA | 3709 | UCCAUUACAACUUGCAGGA | 3710 |
| CAAGUUGUAAUGGAGUUGA | 3711 | UCAACUCCAUUACAACUUG | 3712 |
| AAGUUGUAAUGGAGUUGAG | 3713 | CUCAACUCCAUUACAACUU | 3714 |
| AGUUGUAAUGGAGUUGAGG | 3715 | CCUCAACUCCAUUACAACU | 3716 |
| GUUGUAAUGGAGUUGAGGA | 3717 | UCCUCAACUCCAUUACAAC | 3718 |
| CUGCAGGUGGGACAGGAAG | 3719 | CUUCCUGUCCCACCUGCAG | 3720 |
| GCAGGUGGGACAGGAAGAG | 3721 | CUCUUCCUGUCCCACCUGC | 3722 |
| CAGGUGGGACAGGAAGAGG | 3723 | CCUCUUCCUGUCCCACCUG | 3724 |
| AGGUGGGACAGGAAGAGGC | 3725 | GCCUCUUCCUGUCCCACCU | 3726 |
| GGGACAGGAAGAGGCCAGA | 3727 | UCUGGCCUCUUCCUGUCCC | 3728 |
| GGACAGGAAGAGGCCAGAC | 3729 | GUCUGGCCUCUUCCUGUCC | 3730 |
| GACAGGAAGAGGCCAGACC | 3731 | GGUCUGGCCUCUUCCUGUC | 3732 |
| CAGACCCAGGCCAGAGUAG | 3733 | CUACUCUGGCCUGGGUCUG | 3734 |
| AGACCCAGGCCAGAGUAGA | 3735 | UCUACUCUGGCCUGGGUCU | 3736 |
| GACCCAGGCCAGAGUAGAG | 3737 | CUCUACUCUGGCCUGGGUC | 3738 |
| CCCAGGCCAGAGUAGAGCA | 3739 | UGCUCUACUCUGGCCUGGG | 3740 |
| CAGGCCAGAGUAGAGCAAA | 3741 | UUUGCUCUACUCUGGCCUG | 3742 |
| GCCAGAGUAGAGCAAAUUC | 3743 | GAAUUUGCUCUACUCUGGC | 3744 |
| CCAGAGUAGAGCAAAUUCA | 3745 | UGAAUUUGCUCUACUCUGG | 3746 |
| CAGAGUAGAGCAAAUUCAA | 3747 | UUGAAUUUGCUCUACUCUG | 3748 |
| AGAGUAGAGCAAAUUCAAC | 3749 | GUUGAAUUUGCUCUACUCU | 3750 |
| ACACUAGUCUCUGCUCUGG | 3751 | CCAGAGCAGAGACUAGUGU | 3752 |
| CACUAGUCUCUGCUCUGGC | 3753 | GCCAGAGCAGAGACUAGUG | 3754 |
| CUAGUCUCUGCUCUGGCCG | 3755 | CGGCCAGAGCAGAGACUAG | 3756 |
| UAGUCUCUGCUCUGGCCGA | 3757 | UCGGCCAGAGCAGAGACUA | 3758 |
| AGUCUCUGCUCUGGCCGAG | 3759 | CUCGGCCAGAGCAGAGACU | 3760 |
| CUCUGGCCGAGCAUGAGGU | 3761 | ACCUCAUGCUCGGCCAGAG | 3762 |
| UCUGGCCGAGCAUGAGGUC | 3763 | GACCUCAUGCUCGGCCAGA | 3764 |
| UGGCCGAGCAUGAGGUCCU | 3765 | AGGACCUCAUGCUCGGCCA | 3766 |
| GGCCGAGCAUGAGGUCCUU | 3767 | AAGGACCUCAUGCUCGGCC | 3768 |
| GCCGAGCAUGAGGUCCUUU | 3769 | AAAGGACCUCAUGCUCGGC | 3770 |
| CCGAGCAUGAGGUCCUUUA | 3771 | UAAAGGACCUCAUGCUCGG | 3772 |
| CGAGCAUGAGGUCCUUUAG | 3773 | CUAAAGGACCUCAUGCUCG | 3774 |
| GAGCAUGAGGUCCUUUAGG | 3775 | CCUAAAGGACCUCAUGCUC | 3776 |
| AGCAUGAGGUCCUUUAGGU | 3777 | ACCUAAAGGACCUCAUGCU | 3778 |
| GCAUGAGGUCCUUUAGGUG | 3779 | CACCUAAAGGACCUCAUGC | 3780 |
| CAUGAGGUCCUUUAGGUGC | 3781 | GCACCUAAAGGACCUCAUG | 3782 |
| AUGAGGUCCUUUAGGUGCA | 3783 | UGCACCUAAAGGACCUCAU | 3784 |
| UGAGGUCCUUUAGGUGCAA | 3785 | UUGCACCUAAAGGACCUCA | 3786 |
| GAGGUCCUUUAGGUGCAAA | 3787 | UUUGCACCUAAAGGACCUC | 3788 |
| AGGUCCUUUAGGUGCAAAU | 3789 | AUUUGCACCUAAAGGACCU | 3790 |
| GGUCCUUUAGGUGCAAAUC | 3791 | GAUUUGCACCUAAAGGACC | 3792 |
| GUCCUUUAGGUGCAAAUCU | 3793 | AGAUUUGCACCUAAAGGAC | 3794 |
| UCCUUUAGGUGCAAAUCUU | 3795 | AAGAUUUGCACCUAAAGGA | 3796 |
| CCUUUAGGUGCAAAUCUUA | 3797 | UAAGAUUUGCACCUAAAGG | 3798 |
| CUUUAGGUGCAAAUCUUAC | 3799 | GUAAGAUUUGCACCUAAAG | 3800 |
| UUUAGGUGCAAAUCUUACU | 3801 | AGUAAGAUUUGCACCUAAA | 3802 |
| GCAAAUCUUACUGAUACUG | 3803 | CAGUAUCAGUAAGAUUUGC | 3804 |
| UCUUACUGAUACUGUUUGG | 3805 | CCAAACAGUAUCAGUAAGA | 3806 |
| AAAGCACUCACUAUAUCCU | 3807 | AGGAUAUAGUGAGUGCUUU | 3808 |
| AAGCACUCACUAUAUCCUC | 3809 | GAGGAUAUAGUGAGUGCUU | 3810 |
| ACUCACUAUAUCCUCAUGU | 3811 | ACAUGAGGAUAUAGUGAGU | 3812 |

TABLE 4-continued

| Sense Sequence | SEQ ID NO: | Antisense Sequence | SEQ ID NO: |
|---|---|---|---|
| UCACUAUAUCCUCAUGUUU | 3813 | AAACAUGAGGAUAUAGUGA | 3814 |
| UAUCCUCAUGUUUCUCUUA | 3815 | UAAGAGAAACAUGAGGAUA | 3816 |
| AUCCUCAUGUUUCUCUUAC | 3817 | GUAAGAGAAACAUGAGGAU | 3818 |
| UCCUCAUGUUUCUCUUACA | 3819 | UGUAAGAGAAACAUGAGGA | 3820 |
| CUCAUGUUUCUCUUACAGC | 3821 | GCUGUAAGAGAAACAUGAG | 3822 |
| UCAUGUUUCUCUUACAGCA | 3823 | UGCUGUAAGAGAAACAUGA | 3824 |
| UUCUCUUACAGCAGCUCUG | 3825 | CAGAGCUGCUGUAAGAGAA | 3826 |
| GCAGCUCUGUGUGGGAUUC | 3827 | GAAUCCCACACAGAGCUGC | 3828 |
| ACAUAGCUGCACCUUAUAA | 3829 | UUAUAAGGUGCAGCUAUGU | 3830 |
| CAUAGCUGCACCUUAUAAG | 3831 | CUUAUAAGGUGCAGCUAUG | 3832 |
| AUAGCUGCACCUUAUAAGC | 3833 | GCUUAUAAGGUGCAGCUAU | 3834 |
| UAGCUGCACCUUAUAAGCA | 3835 | UGCUUAUAAGGUGCAGCUA | 3836 |
| AGACUAAUCAAGGCCAUAU | 3837 | AUAUGGCCUUGAUUAGUCU | 3838 |
| GACUAAUCAAGGCCAUAUG | 3839 | CAUAUGGCCUUGAUUAGUC | 3840 |
| ACUAAUCAAGGCCAUAUGG | 3841 | CCAUAUGGCCUUGAUUAGU | 3842 |
| CUAAUCAAGGCCAUAUGGU | 3843 | ACCAUAUGGCCUUGAUUAG | 3844 |
| UAAUCAAGGCCAUAUGGUG | 3845 | CACCAUAUGGCCUUGAUUA | 3846 |
| AAUCAAGGCCAUAUGGUGA | 3847 | UCACCAUAUGGCCUUGAUU | 3848 |
| AUCAAGGCCAUAUGGUGAA | 3849 | UUCACCAUAUGGCCUUGAU | 3850 |
| UCAAGGCCAUAUGGUGAAU | 3851 | AUUCACCAUAUGGCCUUGA | 3852 |
| CAAGGCCAUAUGGUGAAUC | 3853 | GAUUCACCAUAUGGCCUUG | 3854 |
| AAGGCCAUAUGGUGAAUCA | 3855 | UGAUUCACCAUAUGGCCUU | 3856 |
| AAAGAAGUUCGAGCCUUGU | 3857 | ACAAGGCUCGAACUUCUUU | 3858 |
| AAGAAGUUCGAGCCUUGUU | 3859 | AACAAGGCUCGAACUUCUU | 3860 |
| AGAAGUUCGAGCCUUGUUU | 3861 | AAACAAGGCUCGAACUUCU | 3862 |
| GAAGUUCGAGCCUUGUUUU | 3863 | AAAACAAGGCUCGAACUUC | 3864 |
| AAGUUCGAGCCUUGUUUUC | 3865 | GAAAACAAGGCUCGAACUU | 3866 |
| AGUUCGAGCCUUGUUUUCU | 3867 | AGAAAACAAGGCUCGAACU | 3868 |
| GUUCGAGCCUUGUUUUCUG | 3869 | CAGAAAACAAGGCUCGAAC | 3870 |
| UUCGAGCCUUGUUUUCUGA | 3871 | UCAGAAAACAAGGCUCGAA | 3872 |
| UCGAGCCUUGUUUUCUGAU | 3873 | AUCAGAAAACAAGGCUCGA | 3874 |
| CGAGCCUUGUUUUCUGAUU | 3875 | AAUCAGAAAACAAGGCUCG | 3876 |
| UUCUGAUUCCCAGGUUAAC | 3877 | GUUAACCUGGGAAUCAGAA | 3878 |
| AAAAGAUGUUUGGCUAUGG | 3879 | CCAUAGCCAAACAUCUUUU | 3880 |
| AAAGAUGUUUGGCUAUGGG | 3881 | CCCAUAGCCAAACAUCUUU | 3882 |
| AAGAUGUUUGGCUAUGGGA | 3883 | UCCCAUAGCCAAACAUCUU | 3884 |
| AGAUGUUUGGCUAUGGGAC | 3885 | GUCCCAUAGCCAAACAUCU | 3886 |
| GAUGUUUGGCUAUGGGACU | 3887 | AGUCCCAUAGCCAAACAUC | 3888 |
| UUUGGCUAUGGGACUGUCA | 3889 | UGACAGUCCCAUAGCCAAA | 3890 |
| UUGGCUAUGGGACUGUCAG | 3891 | CUGACAGUCCCAUAGCCAA | 3892 |
| UGGCUAUGGGACUGUCAGG | 3893 | CCUGACAGUCCCAUAGCCA | 3894 |
| GAGCCUGCUGCACUUUCUU | 3895 | AAGAAAGUGCAGCAGGCUC | 3896 |
| CUGCUGCACUUUCUUUAAG | 3897 | CUUAAAGAAAGUGCAGCAG | 3898 |
| UGCUGCACUUUCUUUAAGG | 3899 | CCUUAAAGAAAGUGCAGCA | 3900 |
| GCUGCACUUUCUUUAAGGC | 3901 | GCCUUAAAGAAAGUGCAGC | 3902 |
| UGCACUUUCUUUAAGGCUC | 3903 | GAGCCUUAAAGAAAGUGCA | 3904 |
| GCACUUUCUUUAAGGCUCU | 3905 | AGAGCCUUAAAGAAAGUGC | 3906 |
| CACUUUCUUUAAGGCUCUG | 3907 | CAGAGCCUUAAAGAAAGUG | 3908 |
| UUCUUUAAGGCUCUGCUCC | 3909 | GGAGCAGAGCCUUAAAGAA | 3910 |
| GCUCUGCUCCUCCUGACAG | 3911 | CUGUCAGGAGGAGCAGAGC | 3912 |
| AGGACUGGGAGGGCAACCU | 3913 | AGGUUGCCCUCCCAGUCCU | 3914 |
| GCAACCUGCGCUACGCUGA | 3915 | UCAGCGUAGCGCAGGUUGC | 3916 |
| CAACCUGCGCUACGCUGAG | 3917 | CUCAGCGUAGCGCAGGUUG | 3918 |
| CUGCGCUACGCUGAGUAUA | 3919 | UAUACUCAGCGUAGCGCAG | 3920 |
| UGCGCUACGCUGAGUAUAG | 3921 | CUAUACUCAGCGUAGCGCA | 3922 |
| CUACGCUGAGUAUAGCCAC | 3923 | GUGGCUAUACUCAGCGUAG | 3924 |
| UACGCUGAGUAUAGCCACU | 3925 | AGUGGCUAUACUCAGCGUA | 3926 |
| CACUUUGUUUGGGCAAUG | 3927 | CAUUGCCCAAAACAAAGUG | 3928 |
| AACUACACUGGCAAUGUGG | 3929 | CCACAUUGCCAGUGUAGUU | 3930 |
| ACUACACUGGCAAUGUGGG | 3931 | CCCACAUUGCCAGUGUAGU | 3932 |
| AACGACGCCCUCCAGUAUC | 3933 | GAUACUGGAGGGCGUCGUU | 3934 |
| ACGACGCCCUCCAGUAUCA | 3935 | UGAUACUGGAGGGCGUCGU | 3936 |
| CGACGCCCUCCAGUAUCAU | 3937 | AUGAUACUGGAGGGCGUCG | 3938 |
| GACGCCCUCCAGUAUCAUA | 3939 | UAUGAUACUGGAGGGCGUC | 3940 |
| ACGCCCUCCAGUAUCAUAA | 3941 | UUAUGAUACUGGAGGGCGU | 3942 |
| CGCCCUCCAGUAUCAUAAC | 3943 | GUUAUGAUACUGGAGGGCG | 3944 |
| CAAGUGUGCACAGCUCCGC | 3945 | GCGGAGCUGUGCACACUUG | 3946 |
| AAGUGUGCACAGCUCCGCA | 3947 | UGCGGAGCUGUGCACACUU | 3948 |
| AGUGUGCACAGCUCCGCAA | 3949 | UUGCGGAGCUGUGCACACU | 3950 |
| UGCACAGCUCCGCAAAGGU | 3951 | ACCUUUGCGGAGCUGUGCA | 3952 |
| GCACAGCUCCGCAAAGGUG | 3953 | CACCUUUGCGGAGCUGUGC | 3954 |
| CACAGCUCCGCAAAGGUGA | 3955 | UCACCUUUGCGGAGCUGUG | 3956 |
| ACAGCUCCGCAAAGGUGAG | 3957 | CUCACCUUUGCGGAGCUGU | 3958 |
| CAAGCUCAUAAUCCCACUU | 3959 | AAGUGGGAUUAUGAGCUUG | 3960 |
| CAUAAUCCCACUUGAGGAG | 3961 | CUCCUCAAGUGGGAUUAUG | 3962 |
| ACUGUACAGUUGAUAUUCC | 3963 | GGAAUAUCAACUGUACAGU | 3964 |

TABLE 4-continued

| Sense Sequence | SEQ ID NO: | Antisense Sequence | SEQ ID NO: |
|---|---|---|---|
| CUGUACAGUUGAUAUUCCG | 3965 | CGGAAUAUCAACUGUACAG | 3966 |
| UGUACAGUUGAUAUUCCGG | 3967 | CCGGAAUAUCAACUGUACA | 3968 |
| GUACAGUUGAUAUUCCGGU | 3969 | ACCGGAAUAUCAACUGUAC | 3970 |
| UACAGUUGAUAUUCCGGUU | 3971 | AACCGGAAUAUCAACUGUA | 3972 |
| ACAGUUGAUAUUCCGGUUU | 3973 | AAACCGGAAUAUCAACUGU | 3974 |
| CAGUUGAUAUUCCGGUUUU | 3975 | AAAACCGGAAUAUCAACUG | 3976 |
| AGUUGAUAUUCCGGUUUUG | 3977 | CAAAACCGGAAUAUCAACU | 3978 |
| GUUGAUAUUCCGGUUUUGG | 3979 | CCAAAACCGGAAUAUCAAC | 3980 |
| UUGAUAUUCCGGUUUUGGU | 3981 | ACCAAAACCGGAAUAUCAA | 3982 |
| UGAUAUUCCGGUUUUGGUA | 3983 | UACCAAAACCGGAAUAUCA | 3984 |
| GAUAUUCCGGUUUUGGUAU | 3985 | AUACCAAAACCGGAAUAUC | 3986 |
| AUAUUCCGGUUUUGGUAUU | 3987 | AAUACCAAAACCGGAAUAU | 3988 |
| UAUUCCGGUUUUGGUAUUC | 3989 | GAAUACCAAAACCGGAAUA | 3990 |
| AUUCCGGUUUUGGUAUUCU | 3991 | AGAAUACCAAAACCGGAAU | 3992 |
| UUCCGGUUUUGGUAUUCUU | 3993 | AAGAAUACCAAAACCGGAA | 3994 |
| GGUUUUGGUAUUCUUUCUG | 3995 | CAGAAAGAAUACCAAAACC | 3996 |
| UUUUGGUAUUCUUUCUGAC | 3997 | GUCAGAAAGAAUACCAAAA | 3998 |
| GGUAUUCUUUCUGACCCUG | 3999 | CAGGGUCAGAAAGAAUACC | 4000 |
| AACUCCUUACCUGAUGUCU | 4001 | AGACAUCAGGUAAGGAGUU | 4002 |
| ACUCCUUACCUGAUGUCUG | 4003 | CAGACAUCAGGUAAGGAGU | 4004 |
| CUCCUUACCUGAUGUCUGG | 4005 | CCAGACAUCAGGUAAGGAG | 4006 |
| UCCUUACCUGAUGUCUGGU | 4007 | ACCAGACAUCAGGUAAGGA | 4008 |
| CCUUACCUGAUGUCUGGUC | 4009 | GACCAGACAUCAGGUAAGG | 4010 |
| CUUACCUGAUGUCUGGUCU | 4011 | AGACCAGACAUCAGGUAAG | 4012 |
| UUACCUGAUGUCUGGUCUA | 4013 | UAGACCAGACAUCAGGUAA | 4014 |
| UACCUGAUGUCUGGUCUAU | 4015 | AUAGACCAGACAUCAGGUA | 4016 |
| ACCUGAUGUCUGGUCUAUC | 4017 | GAUAGACCAGACAUCAGGU | 4018 |
| GAUGUCUGGUCUAUCACAG | 4019 | CUGUGAUAGACCAGACAUC | 4020 |
| AUGUCUGGUCUAUCACAGU | 4021 | ACUGUGAUAGACCAGACAU | 4022 |
| UGUCUGGUCUAUCACAGUC | 4023 | GACUGUGAUAGACCAGACA | 4024 |
| GUCUGGUCUAUCACAGUCA | 4025 | UGACUGUGAUAGACCAGAC | 4026 |
| UCUGGUCUAUCACAGUCAA | 4027 | UUGACUGUGAUAGACCAGA | 4028 |
| CUGGUCUAUCACAGUCAAC | 4029 | GUUGACUGUGAUAGACCAG | 4030 |
| UGGUCUAUCACAGUCAACU | 4031 | AGUUGACUGUGAUAGACCA | 4032 |
| CUAUCACAGUCAACUUACU | 4033 | AGUAAGUUGACUGUGAUAG | 4034 |
| UAUCACAGUCAACUUACUA | 4035 | UAGUAAGUUGACUGUGAUA | 4036 |
| ACAGUCAACUUACUAGCAC | 4037 | GUGCUAGUAAGUUGACUGU | 4038 |
| AACUUACUAGCACUGGGUC | 4039 | GACCCAGUGCUAGUAAGUU | 4040 |
| ACUUACUAGCACUGGGUCU | 4041 | AGACCCAGUGCUAGUAAGU | 4042 |
| CUUACUAGCACUGGGUCUG | 4043 | CAGACCCAGUGCUAGUAAG | 4044 |
| UUACUAGCACUGGGUCUGU | 4045 | ACAGACCCAGUGCUAGUAA | 4046 |
| UACUAGCACUGGGUCUGUU | 4047 | AACAGACCCAGUGCUAGUA | 4048 |
| ACUAGCACUGGGUCUGUUU | 4049 | AAACAGACCCAGUGCUAGU | 4050 |
| CUGGGUCUGUUUCUCAUGC | 4051 | GCAUGAGAAACAGACCCAG | 4052 |
| UGGGUCUGUUUCUCAUGCC | 4053 | GGCAUGAGAAACAGACCCA | 4054 |
| GGGUCUGUUUCUCAUGCCA | 4055 | UGGCAUGAGAAACAGACCC | 4056 |
| GGUCUGUUUCUCAUGCCAG | 4057 | CUGGCAUGAGAAACAGACC | 4058 |
| UGUUUCUCAUGCCAGGUGG | 4059 | CCACCUGGCAUGAGAAACA | 4060 |
| GUUUCUCAUGCCAGGUGGC | 4061 | GCCACCUGGCAUGAGAAAC | 4062 |
| UUUCUCAUGCCAGGUGGCU | 4063 | AGCCACCUGGCAUGAGAAA | 4064 |
| UUCUCAUGCCAGGUGGCUA | 4065 | UAGCCACCUGGCAUGAGAA | 4066 |
| UCUCAUGCCAGGUGGCUAC | 4067 | GUAGCCACCUGGCAUGAGA | 4068 |
| CUCAUGCCAGGUGGCUACU | 4069 | AGUAGCCACCUGGCAUGAG | 4070 |
| CAACUGCUGCACAGACUCC | 4071 | GGAGUCUGUGCAGCAGUUG | 4072 |
| CACAGACUCCAACCUCAAU | 4073 | AUUGAGGUUGGAGUCUGUG | 4074 |
| ACAGACUCCAACCUCAAUG | 4075 | CAUUGAGGUUGGAGUCUGU | 4076 |
| CAGACUCCAACCUCAAUGG | 4077 | CCAUUGAGGUUGGAGUCUG | 4078 |
| CCAACCUCAAUGGAGUGUA | 4079 | UACACUCCAUUGAGGUUGG | 4080 |
| CAACCUCAAUGGAGUGUAC | 4081 | GUACACUCCAUUGAGGUUG | 4082 |
| AACCUCAAUGGAGUGUACU | 4083 | AGUACACUCCAUUGAGGUU | 4084 |
| ACCUCAAUGGAGUGUACUA | 4085 | UAGUACACUCCAUUGAGGU | 4086 |
| CCUCAAUGGAGUGUACUAC | 4087 | GUAGUACACUCCAUUGAGG | 4088 |
| CUCAAUGGAGUGUACUACC | 4089 | GGUAGUACACUCCAUUGAG | 4090 |
| UCAAUGGAGUGUACUACCG | 4091 | CGGUAGUACACUCCAUUGA | 4092 |
| CAAUGGAGUGUACUACCGC | 4093 | GCGGUAGUACACUCCAUUG | 4094 |
| AAUGGAGUGUACUACCGCC | 4095 | GGCGGUAGUACACUCCAUU | 4096 |
| AUGGAGUGUACUACCGCCU | 4097 | AGGCGGUAGUACACUCCAU | 4098 |
| UGGAGUGUACUACCGCCUG | 4099 | CAGGCGGUAGUACACUCCA | 4100 |
| GGAGUGUACUACCGCCUGG | 4101 | CCAGGCGGUAGUACACUCC | 4102 |
| GAGUGUACUACCGCCUGGG | 4103 | CCCAGGCGGUAGUACACUC | 4104 |
| AGUGUACUACCGCCUGGGU | 4105 | ACCCAGGCGGUAGUACACU | 4106 |
| GUACUACCGCCUGGGUGAG | 4107 | CUCACCCAGGCGGUAGUAC | 4108 |
| UACUACCGCCUGGGUGAGC | 4109 | GCUCACCCAGGCGGUAGUA | 4110 |
| ACUACCGCCUGGGUGAGCA | 4111 | UGCUCACCCAGGCGGUAGU | 4112 |
| CAAUAGCACCUGGAUGGC | 4113 | GCCAUCCAGGUGCUUAUUG | 4114 |
| AAUAAGCACCUGGAUGGCA | 4115 | UGCCAUCCAGGUGCUUAUU | 4116 |

TABLE 4-continued

| Sense Sequence | SEQ ID NO: | Antisense Sequence | SEQ ID NO: |
|---|---|---|---|
| AUAAGCACCUGGAUGGCAU | 4117 | AUGCCAUCCAGGUGCUUAU | 4118 |
| UAAGCACCUGGAUGGCAUC | 4119 | GAUGCCAUCCAGGUGCUUA | 4120 |
| AAGCACCUGGAUGGCAUCA | 4121 | UGAUGCCAUCCAGGUGCUU | 4122 |
| AGCACCUGGAUGGCAUCAC | 4123 | GUGAUGCCAUCCAGGUGCU | 4124 |
| GCACCUGGAUGGCAUCACC | 4125 | GGUGAUGCCAUCCAGGUGC | 4126 |
| CACCUGGAUGGCAUCACCU | 4127 | AGGUGAUGCCAUCCAGGUG | 4128 |
| UGGAUGGCAUCACCUGGUA | 4129 | UACCAGGUGAUGCCAUCCA | 4130 |
| UGGCAUGGAUCUACCUACU | 4131 | AGUAGGUAGAUCCAUGCCA | 4132 |
| GGCAUGGAUCUACCUACUC | 4133 | GAGUAGGUAGAUCCAUGCC | 4134 |
| GCAUGGAUCUACCUACUCC | 4135 | GGAGUAGGUAGAUCCAUGC | 4136 |
| CAUGGAUCUACCUACUCCC | 4137 | GGGAGUAGGUAGAUCCAUG | 4138 |
| AUGGAUCUACCUACUCCCU | 4139 | AGGGAGUAGGUAGAUCCAU | 4140 |
| UGGAUCUACCUACUCCCUC | 4141 | GAGGGAGUAGGUAGAUCCA | 4142 |
| GGAUCUACCUACUCCCUCA | 4143 | UGAGGGAGUAGGUAGAUCC | 4144 |
| GAUCUACCUACUCCCUCAA | 4145 | UUGAGGGAGUAGGUAGAUC | 4146 |
| AUCUACCUACUCCCUCAAA | 4147 | UUUGAGGGAGUAGGUAGAU | 4148 |
| CGCCCAGAAGACUUCAAGC | 4149 | GCUUGAAGUCUUCUGGGCG | 4150 |
| GCCCAGAAGACUUCAAGCC | 4151 | GGCUUGAAGUCUUCUGGGC | 4152 |
| CCCAGAAGACUUCAAGCCU | 4153 | AGGCUUGAAGUCUUCUGGG | 4154 |
| CCAGAAGACUUCAAGCCUU | 4155 | AAGGCUUGAAGUCUUCUGG | 4156 |
| CAGAAGACUUCAAGCCUUA | 4157 | UAAGGCUUGAAGUCUUCUG | 4158 |
| GAAGACUUCAAGCCUUAAA | 4159 | UUUAAGGCUUGAAGUCUUC | 4160 |
| AAGACUUCAAGCCUUAAAA | 4161 | UUUUAAGGCUUGAAGUCUU | 4162 |
| AGACUUCAAGCCUUAAAAG | 4163 | CUUUUAAGGCUUGAAGUCU | 4164 |
| GACUUCAAGCCUUAAAAGG | 4165 | CCUUUUAAGGCUUGAAGUC | 4166 |
| ACUUCAAGCCUUAAAAGGA | 4167 | UCCUUUUAAGGCUUGAAGU | 4168 |
| CUUCAAGCCUUAAAAGGAG | 4169 | CUCCUUUUAAGGCUUGAAG | 4170 |
| UUCAAGCCUUAAAAGGAGG | 4171 | CCUCCUUUUAAGGCUUGAA | 4172 |
| CCUUAAAAGGAGGCUGCCG | 4173 | CGGCAGCCUCCUUUUAAGG | 4174 |
| CUUAAAAGGAGGCUGCCGU | 4175 | ACGGCAGCCUCCUUUUAAG | 4176 |
| UUAAAAGGAGGCUGCCGUG | 4177 | CACGGCAGCCUCCUUUUAA | 4178 |
| UAAAAGGAGGCUGCCGUGG | 4179 | CCACGGCAGCCUCCUUUUA | 4180 |
| AAAAGGAGGCUGCCGUGGA | 4181 | UCCACGGCAGCCUCCUUUU | 4182 |
| AAAGGAGGCUGCCGUGGAG | 4183 | CUCCACGGCAGCCUCCUUU | 4184 |
| GUGGAGCACGGAUACAAGA | 4185 | UUCUGUAUCCGUGCUCCAC | 4186 |
| ACUGGAUGAGGGCAGAUGA | 4187 | UCAUCUGCCCUCAUCCAGU | 4188 |
| CUGGAUGAGGGCAGAUGAG | 4189 | CUCAUCUGCCCUCAUCCAG | 4190 |
| GGAUGAGGGCAGAUGAGGA | 4191 | UCCUCAUCUGCCCUCAUCC | 4192 |
| AUGAGGGCAGAUGAGGACA | 4193 | UGUCCUCAUCUGCCCUCAU | 4194 |
| UGAGGGCAGAUGAGGACAG | 4195 | CUGUCCUCAUCUGCCCUCA | 4196 |
| AGGGCAGAUGAGGACAGGA | 4197 | UCCUGUCCUCAUCUGCCCU | 4198 |
| GGCAGAUGAGGACAGGAAG | 4199 | CUUCCUGUCCUCAUCUGCC | 4200 |
| CAGAUGAGGACAGGAAGAG | 4201 | CUCUUCCUGUCCUCAUCUG | 4202 |
| GAAUAAGCUCCAAGGAGC | 4203 | GCUCCUUGGAGACUAUUC | 4204 |
| AAUAAGUCUCCAAGGAGCA | 4205 | UGCUCCUUGGAGACUUAUU | 4206 |
| AUAAGUCUCCAAGGAGCAC | 4207 | GUGCUCCUUGGAGACUUAU | 4208 |
| GUACCAAGGAUGUUACAGU | 4209 | ACUGUAACAUCCUUGGUAC | 4210 |
| UACCAAGGAUGUUACAGUA | 4211 | UACUGUAACAUCCUUGGUA | 4212 |
| ACCAAGGAUGUUACAGUAA | 4213 | UUACUGUAACAUCCUUGGU | 4214 |
| CCAAGGAUGUUACAGUAAA | 4215 | UUUACUGUAACAUCCUUGG | 4216 |
| CUGGGUCCUGCCACAUCCU | 4217 | AGGAUGUGGCAGGACCCAG | 4218 |
| UGGGUCCUGCCACAUCCUU | 4219 | AAGGAUGUGGCAGGACCCA | 4220 |
| GGGUCCUGCCACAUCCUUC | 4221 | GAAGGAUGUGGCAGGACCC | 4222 |
| GGUCCUGCCACAUCCUUCU | 4223 | AGAAGGAUGUGGCAGGACC | 4224 |
| UCCUGCCACAUCCUUCUCA | 4225 | UGAGAAGGAUGUGGCAGGA | 4226 |
| CCUGCCACAUCCUUCUCAA | 4227 | UUGAGAAGGAUGUGGCAGG | 4228 |
| CUGCCACAUCCUUCUCAAG | 4229 | CUUGAGAAGGAUGUGGCAG | 4230 |
| CUUCUCAAGGUGGUAGACU | 4231 | AGUCUACCACCUUGAGAAG | 4232 |
| AGGUGGUAGACUGAGUGGG | 4233 | CCCACUCAGUCUACCACCU | 4234 |
| GGUCUCUCUGCCCAAGAUC | 4235 | GAUCUUGGGCAGAGAGACC | 4236 |
| GUCUCUCUGCCCAAGAUCC | 4237 | GGAUCUUGGGCAGAGAGAC | 4238 |
| UCUCUCUGCCCAAGAUCCC | 4239 | GGGAUCUUGGGCAGAGAGA | 4240 |
| UCUGCCCAAGAUCCCUGAC | 4241 | GUCAGGGAUCUUGGGCAGA | 4242 |
| CUGCCCAAGAUCCCUGACA | 4243 | UGUCAGGGAUCUUGGGCAG | 4244 |
| UGCCCAAGAUCCCUGACAU | 4245 | AUGUCAGGGAUCUUGGGCA | 4246 |
| GCCCAAGAUCCCUGACAUA | 4247 | UAUGUCAGGGAUCUUGGGC | 4248 |
| CCCAAGAUCCCUGACAUAG | 4249 | CUAUGUCAGGGAUCUUGGG | 4250 |
| AUCCCUGACAUAGCAGUAG | 4251 | CUACUGCUAUGUCAGGGAU | 4252 |
| CCCUGACAUAGCAGUAGCU | 4253 | AGCUACUGCUAUGUCAGGG | 4254 |
| CCUGACAUAGCAGUAGCUU | 4255 | AAGCUACUGCUAUGUCAGG | 4256 |
| CUGACAUAGCAGUAGCUUG | 4257 | CAAGCUACUGCUAUGUCAG | 4258 |
| UGACAUAGCAGUAGCUUGU | 4259 | ACAAGCUACUGCUAUGUCA | 4260 |
| ACAUAGCAGUAGCUUGUCU | 4261 | AGACAAGCUACUGCUAUGU | 4262 |
| CAUAGCAGUAGCUUGUCUU | 4263 | AAGACAAGCUACUGCUAUG | 4264 |
| GCAGUAGCUUGUCUUUUCC | 4265 | GGAAAAGACAAGCUACUGC | 4266 |
| CAGUAGCUUGUCUUUUCCA | 4267 | UGGAAAAGACAAGCUACUG | 4268 |

TABLE 4-continued

| Sense Sequence | SEQ ID NO: | Antisense Sequence | SEQ ID NO: |
|---|---|---|---|
| AGUAGCUUGUCUUUUCCAC | 4269 | GUGGAAAAGACAAGCUACU | 4270 |
| GUAGCUUGUCUUUUCCACA | 4271 | UGUGGAAAAGACAAGCUAC | 4272 |
| CUUGUCUUUUCCACAUGAU | 4273 | AUCAUGUGGAAAAGACAAG | 4274 |
| UUGUCUUUUCCACAUGAUU | 4275 | AAUCAUGUGGAAAAGACAA | 4276 |
| CUUUUCCACAUGAUUUGUC | 4277 | GACAAAUCAUGUGGAAAAG | 4278 |
| UUUUCCACAUGAUUUGUCU | 4279 | AGACAAAUCAUGUGGAAAA | 4280 |
| UUUCCACAUGAUUUGUCUG | 4281 | CAGACAAAUCAUGUGGAAA | 4282 |
| UUCCACAUGAUUUGUCUGU | 4283 | ACAGACAAAUCAUGUGGAA | 4284 |
| GCUUAGGCUAUGUGAGGGC | 4285 | GCCCUCACAUAGCCUAAGC | 4286 |
| AGGCUAUGUGAGGGCAAAA | 4287 | UUUUGCCCUCACAUAGCCU | 4288 |
| AGGAGUGAAGGAGGCAGGU | 4289 | ACCUGCCUCCUUCACUCCU | 4290 |
| GGAGUGAAGGAGGCAGGUG | 4291 | CACCUGCCUCCUUCACUCC | 4292 |
| GAGUGAAGGAGGCAGGUGG | 4293 | CCACCUGCCUCCUUCACUC | 4294 |
| AAUUAUCUUGAGUCUACAC | 4295 | GUGUAGACUCAAGAUAAUU | 4296 |
| ACUCCAGGGCACUGCAUCU | 4297 | AGAUGCAGUGCCCUGGAGU | 4298 |
| CUCCAGGGCACUGCAUCUG | 4299 | CAGAUGCAGUGCCCUGGAG | 4300 |
| AGGGCACUGCAUCUGGCGA | 4301 | UCGCCAGAUGCAGUGCCCU | 4302 |
| GGGCACUGCAUCUGGCGAU | 4303 | AUCGCCAGAUGCAGUGCCC | 4304 |
| GGCACUGCAUCUGGCGAUC | 4305 | GAUCGCCAGAUGCAGUGCC | 4306 |
| GCACUGCAUCUGGCGAUCA | 4307 | UGAUCGCCAGAUGCAGUGC | 4308 |
| CCCUGCUCGCCUUGGUCAU | 4309 | AUGACCAAGGCGAGCAGGG | 4310 |
| CCUGCUCGCCUUGGUCAUG | 4311 | CAUGACCAAGGCGAGCAGG | 4312 |
| CUGCUCGCCUUGGUCAUGU | 4313 | ACAUGACCAAGGCGAGCAG | 4314 |
| UGCUCGCCUUGGUCAUGUA | 4315 | UACAUGACCAAGGCGAGCA | 4316 |
| AUGAAGCACCAGCAGGAGG | 4317 | CCUCCUGCUGGUGCUUCAU | 4318 |
| UGAAGCACCAGCAGGAGGU | 4319 | ACCUCCUGCUGGUGCUUCA | 4320 |
| CAGCAGGAGGUGGACAGAG | 4321 | CUCUGUCCACCUCCUGCUG | 4322 |
| AGCAGGAGGUGGACAGAGU | 4323 | ACUCUGUCCACCUCCUGCU | 4324 |
| GCAGGAGGUGGACAGAGUC | 4325 | GACUCUGUCCACCUCCUGC | 4326 |
| CAGGAGGUGGACAGAGUCU | 4327 | AGACUCUGUCCACCUCCUG | 4328 |
| GGAGGUGGACAGAGUCUCU | 4329 | AGAGACUCUGUCCACCUCC | 4330 |
| AGGUGGACAGAGUCUCUCA | 4331 | UGAGAGACUCUGUCCACCU | 4332 |
| UGGACAGAGUCUCUCAUGG | 4333 | CCAUGAGAGACUCUGUCCA | 4334 |
| GGACAGAGUCUCUCAUGGA | 4335 | UCCAUGAGAGACUCUGUCC | 4336 |
| GACAGAGUCUCUCAUGGAU | 4337 | AUCCAUGAGAGACUCUGUC | 4338 |
| ACAGAGUCUCUCAUGGAUG | 4339 | CAUCCAUGAGAGACUCUGU | 4340 |
| GGAGCUUCCUUUUAAAUUU | 4341 | AAAUUUAAAAGGAAGCUCC | 4342 |
| AACUGAAGGUAGAUGGUGU | 4343 | ACACCAUCUACCUUCAGUU | 4344 |
| ACUGAAGGUAGAUGGUGUU | 4345 | AACACCAUCUACCUUCAGU | 4346 |
| CUGAAGGUAGAUGGUGUUA | 4347 | UAACACCAUCUACCUUCAG | 4348 |
| UGAAGGUAGAUGGUGUUAU | 4349 | AUAACACCAUCUACCUUCA | 4350 |
| GAAGGUAGAUGGUGUUAUA | 4351 | UAUAACACCAUCUACCUUC | 4352 |
| GUAGAUGGUGUUAUAGUUA | 4353 | UAACUAUAACACCAUCUAC | 4354 |
| UGUAAAUAAGCAUCUCACU | 4355 | AGUGAGAUGCUUAUUUACA | 4356 |
| AUAAGCAUCUCACUUUGUA | 4357 | UACAAAGUGAGAUGCUUAU | 4358 |

TABLE 5

| Sense Sequence | SEQ ID NO: | Antisense Sequence | SEQ ID NO: |
|---|---|---|---|
| AAGUGGCCUUGUCUCCUUC | 4359 | GAAGGAGACAAGGCCACUU | 4360 |
| AGUGGCCUUGUCUCCUUCU | 4361 | AGAAGGAGACAAGGCCACU | 4362 |
| GUGGCCUUGUCUCCUUCUA | 4363 | UAGAAGGAGACAAGGCCAC | 4364 |
| CUUGUCUCCUUCUACCGGG | 4365 | CCCGGUAGAAGGAGACAAG | 4366 |
| UUGUCUCCUUCUACCGGGA | 4367 | UCCCGGUAGAAGGAGACAA | 4368 |
| UGUCUCCUUCUACCGGGAC | 4369 | GUCCCGGUAGAAGGAGACA | 4370 |
| GUCUCCUUCUACCGGGACU | 4371 | AGUCCCGGUAGAAGGAGAC | 4372 |
| UUCUACCGGGACUGGAAGC | 4373 | GCUUCCAGUCCCGGUAGAA | 4374 |
| UCUACCGGGACUGGAAGCA | 4375 | UGCUUCCAGUCCCGGUAGA | 4376 |
| CUACCGGGACUGGAAGCAG | 4377 | CUGCUUCCAGUCCCGGUAG | 4378 |
| AGCAGGGCUUUGGCAGCAU | 4379 | AUGCUGCCAAAGCCCUGCU | 4380 |
| AGGGCUUUGGCAGCAUCCG | 4381 | CGGAUGCUGCCAAAGCCCU | 4382 |
| GGGCUUUGGCAGCAUCCGU | 4383 | ACGGAUGCUGCCAAAGCCC | 4384 |
| GGCUUUGGCAGCAUCCGUG | 4385 | CACGGAUGCUGCCAAAGCC | 4386 |
| CAUCCACCGGCUCUCCAGA | 4387 | UCUGGAGAGCCGGUGGAUG | 4388 |
| AUCCACCGGCUCUCCAGAC | 4389 | GUCUGGAGAGCCGGUGGAU | 4390 |
| UCCACCGGCUCUCCAGACA | 4391 | UGUCUGGAGAGCCGGUGGA | 4392 |
| CUGGACCAGUGCCACCACA | 4393 | UGUGGUGGCACUGGUCCAG | 4394 |
| GGGUGCCAUUCCUAUUCUG | 4395 | CAGAAUAGGAAUGGCACCC | 4396 |
| GGUGCCAUUCCUAUUCUGA | 4397 | UCAGAAUAGGAAUGGCACC | 4398 |
| GUGCCAUUCCUAUUCUGAU | 4399 | AUCAGAAUAGGAAUGGCAC | 4400 |
| UGCCAUUCCUAUUCUGAUU | 4401 | AAUCAGAAUAGGAAUGGCA | 4402 |
| AUUCCUAUUCUGAUUCAAG | 4403 | CUUGAAUCAGAAUAGGAAU | 4404 |
| UGUAUUCAUUGUGAUGG | 4405 | CCAUCACAAUGAAUAUACA | 4406 |
| GUAUUCAUUGUGAUGGU | 4407 | ACCAUCACAAUGAAUAUAC | 4408 |
| AUUCAUUGUGAUGGUUUUC | 4409 | GAAAACCAUCACAAUGAAU | 4410 |
| UUCAUUGUGAUGGUUUUCC | 4411 | GGAAAACCAUCACAAUGAA | 4412 |

TABLE 5-continued

| Sense Sequence | SEQ ID NO: | Antisense Sequence | SEQ ID NO: |
|---|---|---|---|
| UGUGAUGGUUUUCCUGCAA | 4413 | UUGCAGGAAAACCAUCACA | 4414 |
| GUGAUGGUUUUCCUGCAAG | 4415 | CUUGCAGGAAAACCAUCAC | 4416 |
| UGAUGGUUUUCCUGCAAGU | 4417 | ACUUGCAGGAAAACCAUCA | 4418 |
| AUGGUUUUCCUGCAAGUUG | 4419 | CAACUUGCAGGAAAACCAU | 4420 |
| GGUUUUCCUGCAAGUUGUA | 4421 | UACAACUUGCAGGAAAACC | 4422 |
| GUUUUCCUGCAAGUUGUAA | 4423 | UUACAACUUGCAGGAAAAC | 4424 |
| UUUUCCUGCAAGUUGUAAU | 4425 | AUUACAACUUGCAGGAAAA | 4426 |
| UUUCCUGCAAGUUGUAAUG | 4427 | CAUUACAACUUGCAGGAAA | 4428 |
| UUCCUGCAAGUUGUAAUGG | 4429 | CCAUUACAACUUGCAGGAA | 4430 |
| UCCUGCAAGUUGUAAUGGA | 4431 | UCCAUUACAACUUGCAGGA | 4432 |
| CAAGUUGUAAUGGAGUUGA | 4433 | UCAACUCCAUUACAACUUG | 4434 |
| AAGUUGUAAUGGAGUUGAG | 4435 | CUCAACUCCAUUACAACUU | 4436 |
| AGUUGUAAUGGAGUUGAGG | 4437 | CCUCAACUCCAUUACAACU | 4438 |
| GUUGUAAUGGAGUUGAGGA | 4439 | UCCUCAACUCCAUUACAAC | 4440 |
| CUGCAGGUGGGACAGGAAG | 4441 | CUUCCUGUCCCACCUGCAG | 4442 |
| GCAGGUGGGACAGGAAGAG | 4443 | CUCUUCCUGUCCCACCUGC | 4444 |
| CAGGUGGGACAGGAAGAGG | 4445 | CCUCUUCCUGUCCCACCUG | 4446 |
| AGGUGGGACAGGAAGAGGC | 4447 | GCCUCUUCCUGUCCCACCU | 4448 |
| GGGACAGGAAGAGGCCAGA | 4449 | UCUGGCCUCUUCCUGUCCC | 4450 |
| GGACAGGAAGAGGCCAGAC | 4451 | GUCUGGCCUCUUCCUGUCC | 4452 |
| GACAGGAAGAGGCCAGACC | 4453 | GGUCUGGCCUCUUCCUGUC | 4454 |
| CAGACCCAGGCCAGAGUAG | 4455 | CUACUCUGGCCUGGGUCUG | 4456 |
| AGACCCAGGCCAGAGUAGA | 4457 | UCUACUCUGGCCUGGGUCU | 4458 |
| GACCCAGGCCAGAGUAGAG | 4459 | CUCUACUCUGGCCUGGGUC | 4460 |
| CCCAGGCCAGAGUAGAGCA | 4461 | UGCUCUACUCUGGCCUGGG | 4462 |
| CAGGCCAGAGUAGAGCAAA | 4463 | UUUGCUCUACUCUGGCCUG | 4464 |
| GCCAGAGUAGAGCAAAUUC | 4465 | GAAUUUGCUCUACUCUGGC | 4466 |
| CCAGAGUAGAGCAAAUUCA | 4467 | UGAAUUUGCUCUACUCUGG | 4468 |
| CAGAGUAGAGCAAAUUCAA | 4469 | UUGAAUUUGCUCUACUCUG | 4470 |
| AGAGUAGAGCAAAUUCAAC | 4471 | GUUGAAUUUGCUCUACUCU | 4472 |
| ACACUAGUCUCUGCUCUGG | 4473 | CCAGAGCAGAGACUAGUGU | 4474 |
| CACUAGUCUCUGCUCUGGC | 4475 | GCCAGAGCAGAGACUAGUG | 4476 |
| CUAGUCUCUGCUCUGGCCG | 4477 | CGGCCAGAGCAGAGACUAG | 4478 |
| UAGUCUCUGCUCUGGCCGA | 4479 | UCGGCCAGAGCAGAGACUA | 4480 |
| AGUCUCUGCUCUGGCCGAG | 4481 | CUCGGCCAGAGCAGAGACU | 4482 |
| CUCUGGCCGAGCAUGAGGU | 4483 | ACCUCAUGCUCGGCCAGAG | 4484 |
| UCUGGCCGAGCAUGAGGUC | 4485 | GACCUCAUGCUCGGCCAGA | 4486 |
| UGGCCGAGCAUGAGGUCCU | 4487 | AGGACCUCAUGCUCGGCCA | 4488 |
| GGCCGAGCAUGAGGUCCUU | 4489 | AAGGACCUCAUGCUCGGCC | 4490 |
| GCCGAGCAUGAGGUCCUUU | 4491 | AAAGGACCUCAUGCUCGGC | 4492 |
| CCGAGCAUGAGGUCCUUUA | 4493 | UAAAGGACCUCAUGCUCGG | 4494 |
| CGAGCAUGAGGUCCUUUAG | 4495 | CUAAAGGACCUCAUGCUCG | 4496 |
| GAGCAUGAGGUCCUUUAGG | 4497 | CCUAAAGGACCUCAUGCUC | 4498 |
| AGCAUGAGGUCCUUUAGGU | 4499 | ACCUAAAGGACCUCAUGCU | 4500 |
| GCAUGAGGUCCUUUAGGUG | 4501 | CACCUAAAGGACCUCAUGC | 4502 |
| CAUGAGGUCCUUUAGGUGC | 4503 | GCACCUAAAGGACCUCAUG | 4504 |
| AUGAGGUCCUUUAGGUGCA | 4505 | UGCACCUAAAGGACCUCAU | 4506 |
| UGAGGUCCUUUAGGUGCAA | 4507 | UUGCACCUAAAGGACCUCA | 4508 |
| GAGGUCCUUUAGGUGCAAA | 4509 | UUUGCACCUAAAGGACCUC | 4510 |
| AGGUCCUUUAGGUGCAAAU | 4511 | AUUUGCACCUAAAGGACCU | 4512 |
| GGUCCUUUAGGUGCAAAUC | 4513 | GAUUUGCACCUAAAGGACC | 4514 |
| GUCCUUUAGGUGCAAAUCU | 4515 | AGAUUUGCACCUAAAGGAC | 4516 |
| UCCUUUAGGUGCAAAUCUU | 4517 | AAGAUUUGCACCUAAAGGA | 4518 |
| CCUUUAGGUGCAAAUCUUA | 4519 | UAAGAUUUGCACCUAAAGG | 4520 |
| CUUUAGGUGCAAAUCUUAC | 4521 | GUAAGAUUUGCACCUAAAG | 4522 |
| UUUAGGUGCAAAUCUUACU | 4523 | AGUAAGAUUUGCACCUAAA | 4524 |
| GCAAAUCUUACUGAUACUG | 4525 | CAGUAUCAGUAAGAUUUGC | 4526 |
| UCUUACUGAUACUGUUGG | 4527 | CCAAACAGUAUCAGUAAGA | 4528 |
| AAAGCACUCACUAUAUCCU | 4529 | AGGAUAUAGUGAGUGCUUU | 4530 |
| AAGCACUCACUAUAUCCUC | 4531 | GAGGAUAUAGUGAGUGCUU | 4532 |
| ACUCACUAUAUCCUCAUGU | 4533 | ACAUGAGGAUAUAGUGAGU | 4534 |
| UCACUAUAUCCUCAUGUUU | 4535 | AAACAUGAGGAUAUAGUGA | 4536 |
| UAUCCUCAUGUUUCUCUUA | 4537 | UAAGAGAAACAUGAGGAUA | 4538 |
| AUCCUCAUGUUUCUCUUAC | 4539 | GUAAGAGAAACAUGAGGAU | 4540 |
| UCCUCAUGUUUCUCUUACA | 4541 | UGUAAGAGAAACAUGAGGA | 4542 |
| CUCAUGUUUCUCUUACAGC | 4543 | GCUGUAAGAGAAACAUGAG | 4544 |
| UCAUGUUUCUCUUACAGCA | 4545 | UGCUGUAAGAGAAACAUGA | 4546 |
| UUCUCUUACAGCAGCUCUG | 4547 | CAGAGCUGCUGUAAGAGAA | 4548 |
| GCAGCUCUGUGUGGGAUUC | 4549 | GAAUCCCACACAGAGCUGC | 4550 |
| ACAUAGCUGCACCUUAUAA | 4551 | UUAUAAGGUGCAGCUAUGU | 4552 |
| CAUAGCUGCACCUUAUAAG | 4553 | CUUAUAAGGUGCAGCUAUG | 4554 |
| AUAGCUGCACCUUAUAAGC | 4555 | GCUUAUAAGGUGCAGCUAU | 4556 |
| UAGCUGCACCUUAUAAGCA | 4557 | UGCUUAUAAGGUGCAGCUA | 4558 |
| AGACUAAUCAAGGCCAUAU | 4559 | AUAUGGCCUUGAUUAGUCU | 4560 |
| GACUAAUCAAGGCCAUAUG | 4561 | CAUAUGGCCUUGAUUAGUC | 4562 |
| ACUAAUCAAGGCCAUAUGG | 4563 | CCAUAUGGCCUUGAUUAGU | 4564 |

TABLE 5-continued

| Sense Sequence | SEQ ID NO: | Antisense Sequence | SEQ ID NO: |
|---|---|---|---|
| CUAAUCAAGGCCAUAUGGU | 4565 | ACCAUAUGGCCUUGAUUAG | 4566 |
| UAAUCAAGGCCAUAUGGUG | 4567 | CACCAUAUGGCCUUGAUUA | 4568 |
| AAUCAAGGCCAUAUGGUGA | 4569 | UCACCAUAUGGCCUUGAUU | 4570 |
| AUCAAGGCCAUAUGGUGAA | 4571 | UUCACCAUAUGGCCUUGAU | 4572 |
| UCAAGGCCAUAUGGUGAAU | 4573 | AUUCACCAUAUGGCCUUGA | 4574 |
| CAAGGCCAUAUGGUGAAUC | 4575 | GAUUCACCAUAUGGCCUUG | 4576 |
| AAGGCCAUAUGGUGAAUCA | 4577 | UGAUUCACCAUAUGGCCUU | 4578 |
| AAAGAAGUUCGAGCCUUGU | 4579 | ACAAGGCUCGAACUUCUUU | 4580 |
| AAGAAGUUCGAGCCUUGUU | 4581 | AACAAGGCUCGAACUUCUU | 4582 |
| AGAAGUUCGAGCCUUGUUU | 4583 | AAACAAGGCUCGAACUUCU | 4584 |
| GAAGUUCGAGCCUUGUUUU | 4585 | AAAACAAGGCUCGAACUUC | 4586 |
| AAGUUCGAGCCUUGUUUUC | 4587 | GAAAACAAGGCUCGAACUU | 4588 |
| AGUUCGAGCCUUGUUUUCU | 4589 | AGAAAACAAGGCUCGAACU | 4590 |
| GUUCGAGCCUUGUUUUCUG | 4591 | CAGAAAACAAGGCUCGAAC | 4592 |
| UUCGAGCCUUGUUUUCUGA | 4593 | UCAGAAAACAAGGCUCGAA | 4594 |
| UCGAGCCUUGUUUUCUGAU | 4595 | AUCAGAAAACAAGGCUCGA | 4596 |
| CGAGCCUUGUUUUCUGAUU | 4597 | AAUCAGAAAACAAGGCUCG | 4598 |
| UUCUGAUUCCCAGGUUAAC | 4599 | GUUAACCUGGGAAUCAGAA | 4600 |
| AAAAGAUGUUUGGCUAUGG | 4601 | CCAUAGCCAAACAUCUUUU | 4602 |
| AAAGAUGUUUGGCUAUGGG | 4603 | CCCAUAGCCAAACAUCUUU | 4604 |
| AAGAUGUUUGGCUAUGGGA | 4605 | UCCCAUAGCCAAACAUCUU | 4606 |
| AGAUGUUUGGCUAUGGGAC | 4607 | GUCCCAUAGCCAAACAUCU | 4608 |
| GAUGUUUGGCUAUGGGACU | 4609 | AGUCCCAUAGCCAAACAUC | 4610 |
| UUUGGCUAUGGGACUGUCA | 4611 | UGACAGUCCCAUAGCCAAA | 4612 |
| UUGGCUAUGGGACUGUCAG | 4613 | CUGACAGUCCCAUAGCCAA | 4614 |
| UGGCUAUGGGACUGUCAGG | 4615 | CCUGACAGUCCCAUAGCCA | 4616 |
| GAGCCUGCUGCACUUUCUU | 4617 | AAGAAAGUGCAGCAGGCUC | 4618 |
| CUGCUGCACUUUCUUUAAG | 4619 | CUUAAAGAAAGUGCAGCAG | 4620 |
| UGCUGCACUUUCUUUAAGG | 4621 | CCUUAAAGAAAGUGCAGCA | 4622 |
| GCUGCACUUUCUUUAAGGC | 4623 | GCCUUAAAGAAAGUGCAGC | 4624 |
| UGCACUUUCUUUAAGGCUC | 4625 | GAGCCUUAAAGAAAGUGCA | 4626 |
| GCACUUUCUUUAAGGCUCU | 4627 | AGAGCCUUAAAGAAAGUGC | 4628 |
| CACUUUCUUUAAGGCUCUG | 4629 | CAGAGCCUUAAAGAAAGUG | 4630 |
| UUCUUUAAGGCUCUGCUCC | 4631 | GGAGCAGAGCCUUAAAGAA | 4632 |
| GCUCUGCUCCUCCUGACAG | 4633 | CUGUCAGGAGGAGCAGAGC | 4634 |
| AGGACUGGGAGGGCAACCU | 4635 | AGGUUGCCCUCCCAGUCCU | 4636 |
| GCAACCUGCGCUACGCUGA | 4637 | UCAGCGUAGCGCAGGUUGC | 4638 |
| CAACCUGCGCUACGCUGAG | 4639 | CUCAGCGUAGCGCAGGUUG | 4640 |
| CUGCGCUACGCUGAGUAUA | 4641 | UAUACUCAGCGUAGCGCAG | 4642 |
| UGCGCUACGCUGAGUAUAG | 4643 | CUAUACUCAGCGUAGCGCA | 4644 |
| CUACGCUGAGUAUAGCCAC | 4645 | GUGGCUAUACUCAGCGUAG | 4646 |
| UACGCUGAGUAUAGCCACU | 4647 | AGUGGCUAUACUCAGCGUA | 4648 |
| CACUUUGUUUUGGGCAAUG | 4649 | CAUUGCCCAAAACAAAGUG | 4650 |
| AACUACACUGGCAAUGUGG | 4651 | CCACAUUGCCAGUGUAGUU | 4652 |
| ACUACACUGGCAAUGUGGG | 4653 | CCCACAUUGCCAGUGUAGU | 4654 |
| AACGACGCCCUCCAGUAUC | 4655 | GAUACUGGAGGGCGUCGUU | 4656 |
| ACGACGCCCUCCAGUAUCA | 4657 | UGAUACUGGAGGGCGUCGU | 4658 |
| CGACGCCCUCCAGUAUCAU | 4659 | AUGAUACUGGAGGGCGUCG | 4660 |
| GACGCCCUCCAGUAUCAUA | 4661 | UAUGAUACUGGAGGGCGUC | 4662 |
| ACGCCCUCCAGUAUCAUAA | 4663 | UUAUGAUACUGGAGGGCGU | 4664 |
| CGCCCUCCAGUAUCAUAAC | 4665 | GUUAUGAUACUGGAGGGCG | 4666 |
| CAAGUGUGCACAGCUCCGC | 4667 | GCGGAGCUGUGCACACUUG | 4668 |
| AAGUGUGCACAGCUCCGCA | 4669 | UGCGGAGCUGUGCACACUU | 4670 |
| AGUGUGCACAGCUCCGCAA | 4671 | UUGCGGAGCUGUGCACACU | 4672 |
| UGCACAGCUCCGCAAAGGU | 4673 | ACCUUUGCGGAGCUGUGCA | 4674 |
| GCACAGCUCCGCAAAGGUG | 4675 | CACCUUUGCGGAGCUGUGC | 4676 |
| CACAGCUCCGCAAAGGUGA | 4677 | UCACCUUUGCGGAGCUGUG | 4678 |
| ACAGCUCCGCAAAGGUGAG | 4679 | CUCACCUUUGCGGAGCUGU | 4680 |
| CAAGCUCAUAAUCCCACUU | 4681 | AAGUGGGAUUAUGAGCUUG | 4682 |
| CAUAAUCCCACUUGAGGAG | 4683 | CUCCUCAAGUGGGAUUAUG | 4684 |
| ACUGUACAGUUGAUAUUCC | 4685 | GGAAUAUCAACUGUACAGU | 4686 |
| CUGUACAGUUGAUAUUCCG | 4687 | CGGAAUAUCAACUGUACAG | 4688 |
| UGUACAGUUGAUAUUCCGG | 4689 | CCGGAAUAUCAACUGUACA | 4690 |
| GUACAGUUGAUAUUCCGGU | 4691 | ACCGGAAUAUCAACUGUAC | 4692 |
| UACAGUUGAUAUUCCGGUU | 4693 | AACCGGAAUAUCAACUGUA | 4694 |
| ACAGUUGAUAUUCCGGUUU | 4695 | AAACCGGAAUAUCAACUGU | 4696 |
| CAGUUGAUAUUCCGGUUUU | 4697 | AAAACCGGAAUAUCAACUG | 4698 |
| AGUUGAUAUUCCGGUUUUG | 4699 | CAAAACCGGAAUAUCAACU | 4700 |
| GUUGAUAUUCCGGUUUUGG | 4701 | CCAAAACCGGAAUAUCAAC | 4702 |
| UUGAUAUUCCGGUUUUGGU | 4703 | ACCAAAACCGGAAUAUCAA | 4704 |
| UGAUAUUCCGGUUUUGGUA | 4705 | UACCAAAACCGGAAUAUCA | 4706 |
| GAUAUUCCGGUUUUGGUAU | 4707 | AUACCAAAACCGGAAUAUC | 4708 |
| AUAUUCCGGUUUUGGUAUU | 4709 | AAUACCAAAACCGGAAUAU | 4710 |
| UAUUCCGGUUUUGGUAUUC | 4711 | GAAUACCAAAACCGGAAUA | 4712 |
| AUUCCGGUUUUGGUAUUCU | 4713 | AGAAUACCAAAACCGGAAU | 4714 |
| UUCCGGUUUUGGUAUUCUU | 4715 | AAGAAUACCAAAACCGGAA | 4716 |

TABLE 5-continued

| Sense Sequence | SEQ ID NO: | Antisense Sequence | SEQ ID NO: |
| --- | --- | --- | --- |
| GGUUUUGGUAUUCUUUCUG | 4717 | CAGAAAGAAUACCAAAACC | 4718 |
| UUUUGGUAUUCUUUCUGAC | 4719 | GUCAGAAAGAAUACCAAAA | 4720 |
| GGUAUUCUUUCUGACCCUG | 4721 | CAGGGUCAGAAAGAAUACC | 4722 |
| AACUCCUUACCUGAUGUCU | 4723 | AGACAUCAGGUAAGGAGUU | 4724 |
| ACUCCUUACCUGAUGUCUG | 4725 | CAGACAUCAGGUAAGGAGU | 4726 |
| CUCCUUACCUGAUGUCUGG | 4727 | CCAGACAUCAGGUAAGGAG | 4728 |
| UCCUUACCUGAUGUCUGGU | 4729 | ACCAGACAUCAGGUAAGGA | 4730 |
| CCUUACCUGAUGUCUGGUC | 4731 | GACCAGACAUCAGGUAAGG | 4732 |
| CUUACCUGAUGUCUGGUCU | 4733 | AGACCAGACAUCAGGUAAG | 4734 |
| UUACCUGAUGUCUGGUCUA | 4735 | UAGACCAGACAUCAGGUAA | 4736 |
| UACCUGAUGUCUGGUCUAU | 4737 | AUAGACCAGACAUCAGGUA | 4738 |
| ACCUGAUGUCUGGUCUAUC | 4739 | GAUAGACCAGACAUCAGGU | 4740 |
| GAUGUCUGGUCUAUCACAG | 4741 | CUGUGAUAGACCAGACAUC | 4742 |
| AUGUCUGGUCUAUCACAGU | 4743 | ACUGUGAUAGACCAGACAU | 4744 |
| UGUCUGGUCUAUCACAGUC | 4745 | GACUGUGAUAGACCAGACA | 4746 |
| GUCUGGUCUAUCACAGUCA | 4747 | UGACUGUGAUAGACCAGAC | 4748 |
| UCUGGUCUAUCACAGUCAA | 4749 | UUGACUGUGAUAGACCAGA | 4750 |
| CUGGUCUAUCACAGUCAAC | 4751 | GUUGACUGUGAUAGACCAG | 4752 |
| UGGUCUAUCACAGUCAACU | 4753 | AGUUGACUGUGAUAGACCA | 4754 |
| CUAUCACAGUCAACUUACU | 4755 | AGUAAGUUGACUGUGAUAG | 4756 |
| UAUCACAGUCAACUUACUA | 4757 | UAGUAAGUUGACUGUGAUA | 4758 |
| ACAGUCAACUUACUAGCAC | 4759 | GUGCUAGUAAGUUGACUGU | 4760 |
| AACUUACUAGCACUGGGUC | 4761 | GACCCAGUGCUAGUAAGUU | 4762 |
| ACUUACUAGCACUGGGUCU | 4763 | AGACCCAGUGCUAGUAAGU | 4764 |
| CUUACUAGCACUGGGUCUG | 4765 | CAGACCCAGUGCUAGUAAG | 4766 |
| UUACUAGCACUGGGUCUGU | 4767 | ACAGACCCAGUGCUAGUAA | 4768 |
| UACUAGCACUGGGUCUGUU | 4769 | AACAGACCCAGUGCUAGUA | 4770 |
| ACUAGCACUGGGUCUGUUU | 4771 | AAACAGACCCAGUGCUAGU | 4772 |
| CUGGGUCUGUUUCUCAUGC | 4773 | GCAUGAGAAACAGACCCAG | 4774 |
| UGGGUCUGUUUCUCAUGCC | 4775 | GGCAUGAGAAACAGACCCA | 4776 |
| GGGUCUGUUUCUCAUGCCA | 4777 | UGGCAUGAGAAACAGACCC | 4778 |
| GGUCUGUUUCUCAUGCCAG | 4779 | CUGGCAUGAGAAACAGACC | 4780 |
| UGUUUCUCAUGCCAGGUGG | 4781 | CCACCUGGCAUGAGAAACA | 4782 |
| GUUUCUCAUGCCAGGUGGC | 4783 | GCCACCUGGCAUGAGAAAC | 4784 |
| UUUCUCAUGCCAGGUGGCU | 4785 | AGCCACCUGGCAUGAGAAA | 4786 |
| UUCUCAUGCCAGGUGGCUA | 4787 | UAGCCACCUGGCAUGAGAA | 4788 |
| UCUCAUGCCAGGUGGCUAC | 4789 | GUAGCCACCUGGCAUGAGA | 4790 |
| CUCAUGCCAGGUGGCUACU | 4791 | AGUAGCCACCUGGCAUGAG | 4792 |
| CAACUGCUGCACAGACUCC | 4793 | GGAGUCUGUGCAGCAGUUG | 4794 |
| CACAGACUCCAACCUCAAU | 4795 | AUUGAGGUUGGAGUCUGUG | 4796 |
| ACAGACUCCAACCUCAAUG | 4797 | CAUUGAGGUUGGAGUCUGU | 4798 |
| CAGACUCCAACCUCAAUGG | 4799 | CCAUUGAGGUUGGAGUCUG | 4800 |
| CCAACCUCAAUGGAGUGUA | 4801 | UACACUCCAUUGAGGUUGG | 4802 |
| CAACCUCAAUGGAGUGUAC | 4803 | GUACACUCCAUUGAGGUUG | 4804 |
| AACCUCAAUGGAGUGUACU | 4805 | AGUACACUCCAUUGAGGUU | 4806 |
| ACCUCAAUGGAGUGUACUA | 4807 | UAGUACACUCCAUUGAGGU | 4808 |
| CCUCAAUGGAGUGUACUAC | 4809 | GUAGUACACUCCAUUGAGG | 4810 |
| CUCAAUGGAGUGUACUACC | 4811 | GGUAGUACACUCCAUUGAG | 4812 |
| UCAAUGGAGUGUACUACCG | 4813 | CGGUAGUACACUCCAUUGA | 4814 |
| CAAUGGAGUGUACUACCGC | 4815 | GCGGUAGUACACUCCAUUG | 4816 |
| AAUGGAGUGUACUACCGCC | 4817 | GGCGGUAGUACACUCCAUU | 4818 |
| AUGGAGUGUACUACCGCCU | 4819 | AGGCGGUAGUACACUCCAU | 4820 |
| UGGAGUGUACUACCGCCUG | 4821 | CAGGCGGUAGUACACUCCA | 4822 |
| GGAGUGUACUACCGCCUGG | 4823 | CCAGGCGGUAGUACACUCC | 4824 |
| GAGUGUACUACCGCCUGGG | 4825 | CCCAGGCGGUAGUACACUC | 4826 |
| AGUGUACUACCGCCUGGGU | 4827 | ACCCAGGCGGUAGUACACU | 4828 |
| GUACUACCGCCUGGGUGAG | 4829 | CUCACCCAGGCGGUAGUAC | 4830 |
| UACUACCGCCUGGGUGAGC | 4831 | GCUCACCCAGGCGGUAGUA | 4832 |
| ACUACCGCCUGGGUGAGCA | 4833 | UGCUCACCCAGGCGGUAGU | 4834 |
| CAAUAAGCACCUGGAUGGC | 4835 | GCCAUCCAGGUGCUUAUUG | 4836 |
| AAUAAGCACCUGGAUGGCA | 4837 | UGCCAUCCAGGUGCUUAUU | 4838 |
| AUAAGCACCUGGAUGGCAU | 4839 | AUGCCAUCCAGGUGCUUAU | 4840 |
| UAAGCACCUGGAUGGCAUC | 4841 | GAUGCCAUCCAGGUGCUUA | 4842 |
| AAGCACCUGGAUGGCAUCA | 4843 | UGAUGCCAUCCAGGUGCUU | 4844 |
| AGCACCUGGAUGGCAUCAC | 4845 | GUGAUGCCAUCCAGGUGCU | 4846 |
| GCACCUGGAUGGCAUCACC | 4847 | GGUGAUGCCAUCCAGGUGC | 4848 |
| CACCUGGAUGGCAUCACCU | 4849 | AGGUGAUGCCAUCCAGGUG | 4850 |
| UGGAUGGCAUCACCUGGUA | 4851 | UACCAGGUGAUGCCAUCCA | 4852 |
| UGGCAUGGAUCUACCUACU | 4853 | AGUAGGUAGAUCCAUGCCA | 4854 |
| GGCAUGGAUCUACCUACUC | 4855 | GAGUAGGUAGAUCCAUGCC | 4856 |
| GCAUGGAUCUACCUACUCC | 4857 | GGAGUAGGUAGAUCCAUGC | 4858 |
| CAUGGAUCUACCUACUCCC | 4859 | GGGAGUAGGUAGAUCCAUG | 4860 |
| AUGGAUCUACCUACUCCCU | 4861 | AGGGAGUAGGUAGAUCCAU | 4862 |
| UGGAUCUACCUACUCCCUC | 4863 | GAGGGAGUAGGUAGAUCCA | 4864 |
| GGAUCUACCUACUCCCUCA | 4865 | UGAGGGAGUAGGUAGAUCC | 4866 |
| GAUCUACCUACUCCCUCAA | 4867 | UUGAGGGAGUAGGUAGAUC | 4868 |

TABLE 5-continued

| Sense Sequence | SEQ ID NO: | Antisense Sequence | SEQ ID NO: |
| --- | --- | --- | --- |
| AUCUACCUACUCCCUCAAA | 4869 | UUUGAGGGAGUAGGUAGAU | 4870 |
| CGCCCAGAAGACUUCAAGC | 4871 | GCUUGAAGUCUUCUGGGCG | 4872 |
| GCCCAGAAGACUUCAAGCC | 4873 | GGCUUGAAGUCUUCUGGGC | 4874 |
| CCCAGAAGACUUCAAGCCU | 4875 | AGGCUUGAAGUCUUCUGGG | 4876 |
| CCAGAAGACUUCAAGCCUU | 4877 | AAGGCUUGAAGUCUUCUGG | 4878 |
| CAGAAGACUUCAAGCCUUA | 4879 | UAAGGCUUGAAGUCUUCUG | 4880 |
| GAAGACUUCAAGCCUUAAA | 4881 | UUUAAGGCUUGAAGUCUUC | 4882 |
| AAGACUUCAAGCCUUAAAA | 4883 | UUUUAAGGCUUGAAGUCUU | 4884 |
| AGACUUCAAGCCUUAAAAG | 4885 | CUUUUAAGGCUUGAAGUCU | 4886 |
| GACUUCAAGCCUUAAAAGG | 4887 | CCUUUUAAGGCUUGAAGUC | 4888 |
| ACUUCAAGCCUUAAAAGGA | 4889 | UCCUUUUAAGGCUUGAAGU | 4890 |
| CUUCAAGCCUUAAAAGGAG | 4891 | CUCCUUUUAAGGCUUGAAG | 4892 |
| UUCAAGCCUUAAAAGGAGG | 4893 | CCUCCUUUUAAGGCUUGAA | 4894 |
| CCUUAAAAGGAGGCUGCCG | 4895 | CGGCAGCCUCCUUUUAAGG | 4896 |
| CUUAAAAGGAGGCUGCCGU | 4897 | ACGGCAGCCUCCUUUUAAG | 4898 |
| UUAAAAGGAGGCUGCCGUG | 4899 | CACGGCAGCCUCCUUUUAA | 4900 |
| UAAAAGGAGGCUGCCGUGG | 4901 | CCACGGCAGCCUCCUUUUA | 4902 |
| AAAAGGAGGCUGCCGUGGA | 4903 | UCCACGGCAGCCUCCUUUU | 4904 |
| AAAGGAGGCUGCCGUGGAG | 4905 | CUCCACGGCAGCCUCCUUU | 4906 |
| GUGGAGCACGGAUACAAGA | 4907 | UUCUGUAUCCGUGCUCCAC | 4908 |
| ACUGGAUGAGGGCAGAUGA | 4909 | UCAUCUGCCCUCAUCCAGU | 4910 |
| CUGGAUGAGGGCAGAUGAG | 4911 | CUCAUCUGCCCUCAUCCAG | 4912 |
| GGAUGAGGGCAGAUGAGGA | 4913 | UCCUCAUCUGCCCUCAUCC | 4914 |
| AUGAGGGCAGAUGAGGACA | 4915 | UGUCCUCAUCUGCCCUCAU | 4916 |
| UGAGGGCAGAUGAGGACAG | 4917 | CUGUCCUCAUCUGCCCUCA | 4918 |
| AGGGCAGAUGAGGACAGGA | 4919 | UCCUGUCCUCAUCUGCCCU | 4920 |
| GGCAGAUGAGGACAGGAAG | 4921 | CUUCCUGUCCUCAUCUGCC | 4922 |
| CAGAUGAGGACAGGAAGAG | 4923 | CUCUUCCUGUCCUCAUCUG | 4924 |
| GAAUAAGUCUCCAAGGAGC | 4925 | GCUCCUUGGAGACUUAUUC | 4926 |
| AAUAAGUCUCCAAGGAGCA | 4927 | UGCUCCUUGGAGACUUAUU | 4928 |
| AUAAGUCUCCAAGGAGCAC | 4929 | GUGCUCCUUGGAGACUUAU | 4930 |

TABLE 6

| Sense Sequence | SEQ ID NO: | Antisense Sequence | SEQ ID NO: |
| --- | --- | --- | --- |
| AAAGGCUAGCAAAGAGCAA | 4931 | UUGCUCUUUGCUAGCCUUU | 4932 |
| AAGGCUAGCAAAGAGCAAG | 4933 | CUUGCUCUUUGCUAGCCUU | 4934 |

TABLE 6-continued

| Sense Sequence | SEQ ID NO: | Antisense Sequence | SEQ ID NO: |
| --- | --- | --- | --- |
| AGGCUAGCAAAGAGCAAGG | 4935 | CCUUGCUCUUUGCUAGCCU | 4936 |
| GGCUAGCAAAGAGCAAGGA | 4937 | UCCUUGCUCUUUGCUAGCC | 4938 |
| GCUAGCAAAGAGCAAGGAA | 4939 | UUCCUUGCUCUUUGCUAGC | 4940 |
| CAAAGUGGCGAGGCCCUCA | 4941 | UGAGGGCCUCGCCACUUUG | 4942 |
| AAAGUGGCGAGGCCCUCAG | 4943 | CUGAGGGCCUCGCCACUUU | 4944 |
| AAGUGGCGAGGCCCUCAGA | 4945 | UCUGAGGGCCUCGCCACUU | 4946 |
| GCGAGGCCCUCAGAGUGAA | 4947 | UUCACUCUGAGGGCCUCGC | 4948 |
| AAAGCGUAAGGUUCAGUCA | 4949 | UGACUGAACCUUACGCUUU | 4950 |
| AAGAGCCUUCCUCACCCAA | 4951 | UUGGGUGAGGAAGGCUCUU | 4952 |
| AGAGCCUUCCUCACCCAAA | 4953 | UUUGGGUGAGGAAGGCUCU | 4954 |
| AAAAGCCUCUCUCAGCUGU | 4955 | ACAGCUGAGAGAGGCUUUU | 4956 |
| AAAGCCUCUCUCAGCUGUG | 4957 | CACAGCUGAGAGAGGCUUU | 4958 |
| UCAGCUGUGACCUGGCUCU | 4959 | AGAGCCAGGUCACAGCUGA | 4960 |
| UGACCUGGCUCUGCAUUUU | 4961 | AAAAUGCAGAGCCAGGUCA | 4962 |
| ACCUGGCUCUGCAUUUUCA | 4963 | UGAAAAUGCAGAGCCAGGU | 4964 |
| CCUGGCUCUGCAUUUUCAU | 4965 | AUGAAAAUGCAGAGCCAGG | 4966 |
| GCUCUGCAUUUUCAUCGUG | 4967 | CACGAUGAAAAUGCAGAGC | 4968 |
| CUCUGCAUUUUCAUCGUGG | 4969 | CCACGAUGAAAAUGCAGAG | 4970 |
| UCUGCAUUUUCAUCGUGGC | 4971 | GCCACGAUGAAAAUGCAGA | 4972 |
| CUGCAUUUUCAUCGUGGCC | 4973 | GGCCACGAUGAAAAUGCAG | 4974 |
| UGCAUUUUCAUCGUGGCCU | 4975 | AGGCCACGAUGAAAAUGCA | 4976 |
| GCAUUUUCAUCGUGGCCUU | 4977 | AAGGCCACGAUGAAAAUGC | 4978 |
| AUUUUCAUCGUGGCCUUUG | 4979 | CAAAGGCCACGAUGAAAAU | 4980 |
| UUUUCAUCGUGGCCUUUGU | 4981 | ACAAAGGCCACGAUGAAAA | 4982 |
| UUUCAUCGUGGCCUUUGUC | 4983 | GACAAAGGCCACGAUGAAA | 4984 |
| UUCAUCGUGGCCUUUGUCA | 4985 | UGACAAAGGCCACGAUGAA | 4986 |
| UCAUCGUGGCCUUUGUCAG | 4987 | CUGACAAAGGCCACGAUGA | 4988 |
| CAUCGUGGCCUUUGUCAGC | 4989 | GCUGACAAAGGCCACGAUG | 4990 |
| AUCGUGGCCUUUGUCAGCC | 4991 | GGCUGACAAAGGCCACGAU | 4992 |
| CCUUUGUCAGCCACCCAGC | 4993 | GCUGGGUGGCUGACAAAGG | 4994 |
| CUUUGUCAGCCACCCAGCG | 4995 | CGCUGGGUGGCUGACAAAG | 4996 |
| UUGUCAGCCACCCAGCGUG | 4997 | CACGCUGGGUGGCUGACAA | 4998 |
| GUGGCUGCAGAAGCUCUCU | 4999 | AGAGAGCUUCUGCAGCCAC | 5000 |
| UGGCUGCAGAAGCUCUCUA | 5001 | UAGAGAGCUUCUGCAGCCA | 5002 |
| GGCUGCAGAAGCUCUCUAA | 5003 | UUAGAGAGCUUCUGCAGCC | 5004 |
| GCUGCAGAAGCUCUCUAAG | 5005 | CUUAGAGAGCUUCUGCAGC | 5006 |
| CUGCAGAAGCUCUCUAAGC | 5007 | GCUUAGAGAGCUUCUGCAG | 5008 |
| UGCAGAAGCUCUCUAAGCA | 5009 | UGCUUAGAGAGCUUCUGCA | 5010 |

TABLE 6-continued

| Sense Sequence | SEQ ID NO: | Antisense Sequence | SEQ ID NO: |
|---|---|---|---|
| GCAGAAGCUCUCUAAGCAC | 5011 | GUGCUUAGAGAGCUUCUGC | 5012 |
| CCAGCACAGCCACAGCUCA | 5013 | UGAGCUGUGGCUGUGCUGG | 5014 |
| CAGCACAGCCACAGCUCAA | 5015 | UUGAGCUGUGGCUGUGCUG | 5016 |
| GCACAGCCACAGCUCAAAG | 5017 | CUUUGAGCUGUGGCUGUGC | 5018 |
| CACAGCCACAGCUCAAAGC | 5019 | GCUUUGAGCUGUGGCUGUG | 5020 |
| ACAGCCACAGCUCAAAGCG | 5021 | CGCUUUGAGCUGUGGCUGU | 5022 |
| CAGCCACAGCUCAAAGCGG | 5023 | CCGCUUUGAGCUGUGGCUG | 5024 |
| AGCCACAGCUCAAAGCGGC | 5025 | GCCGCUUUGAGCUGUGGCU | 5026 |
| GGCCAACUGCUGUGAGGAG | 5027 | CUCCUCACAGCAGUUGGCC | 5028 |
| GCCAACUGCUGUGAGGAGG | 5029 | CCUCCUCACAGCAGUUGGC | 5030 |
| CCAACUGCUGUGAGGAGGU | 5031 | ACCUCCUCACAGCAGUUGG | 5032 |
| CAACUGCUGUGAGGAGGUG | 5033 | CACCUCCUCACAGCAGUUG | 5034 |
| AACUGCUGUGAGGAGGUGA | 5035 | UCACCUCCUCACAGCAGUU | 5036 |
| ACUGCUGUGAGGAGGUGAA | 5037 | UUCACCUCCUCACAGCAGU | 5038 |
| CUCAAGGCCCAAGUUGCCA | 5039 | UGGCAACUUGGGCCUUGAG | 5040 |
| GCCCAAGUUGCCAACCUUA | 5041 | UAAGGUUGGCAACUUGGGC | 5042 |
| CCCAAGUUGCCAACCUUAG | 5043 | CUAAGGUUGGCAACUUGGG | 5044 |
| CCAAGUUGCCAACCUUAGC | 5045 | GCUAAGGUUGGCAACUUGG | 5046 |
| CAAGUUGCCAACCUUAGCA | 5047 | UGCUAAGGUUGGCAACUUG | 5048 |
| AAGUUGCCAACCUUAGCAG | 5049 | CUGCUAAGGUUGGCAACUU | 5050 |
| AGUUGCCAACCUUAGCAGC | 5051 | GCUGCUAAGGUUGGCAACU | 5052 |
| GACUGGGUCAGCGUGGUCA | 5053 | UGACCACGCUGACCCAGUC | 5054 |
| ACUGGGUCAGCGUGGUCAU | 5055 | AUGACCACGCUGACCCAGU | 5056 |
| CUGGGUCAGCGUGGUCAUG | 5057 | CAUGACCACGCUGACCCAG | 5058 |
| UGGGUCAGCGUGGUCAUGC | 5059 | GCAUGACCACGCUGACCCA | 5060 |
| GGGUCAGCGUGGUCAUGCA | 5061 | UGCAUGACCACGCUGACCC | 5062 |
| CAGCGUGGUCAUGCAGGUG | 5063 | CACCUGCAUGACCACGCUG | 5064 |
| AGCGUGGUCAUGCAGGUGA | 5065 | UCACCUGCAUGACCACGCU | 5066 |
| GCGUGGUCAUGCAGGUGAU | 5067 | AUCACCUGCAUGACCACGC | 5068 |
| CGUGGUCAUGCAGGUGAUG | 5069 | CAUCACCUGCAUGACCACG | 5070 |
| AGCAAGCGCAUGGAGCGC | 5071 | GCGACUCCAUGCGCUUGCU | 5072 |
| CAACCAAAUUGACAUCAUG | 5073 | CAUGAUGUCAAUUUGGUUG | 5074 |
| ACCAAAUUGACAUCAUGCA | 5075 | UGCAUGAUGUCAAUUUGGU | 5076 |
| UUGACAUCAUGCAGCUGCA | 5077 | UGCAGCUGCAUGAUGUCAA | 5078 |
| CAGGCAGCACAGACGGUCA | 5079 | UGACCGUCUGUGCUGCCUG | 5080 |
| AGGCAGCACAGACGGUCAC | 5081 | GUGACCGUCUGUGCUGCCU | 5082 |
| GGCAGCACAGACGGUCACU | 5083 | AGUGACCGUCUGUGCUGCC | 5084 |
| GCAGCACAGACGGUCACUC | 5085 | GAGUGACCGUCUGUGCUGC | 5086 |
| GUCACUCAGACCUCCGCAG | 5087 | CUGCGGAGGUCUGAGUGAC | 5088 |
| UCACUCAGACCUCCGCAGA | 5089 | UCUGCGGAGGUCUGAGUGA | 5090 |
| CACUCAGACCUCCGCAGAU | 5091 | AUCUGCGGAGGUCUGAGUG | 5092 |
| ACUCAGACCUCCGCAGAUG | 5093 | CAUCUGCGGAGGUCUGAGU | 5094 |
| CUCAGACCUCCGCAGAUGC | 5095 | GCAUCUGCGGAGGUCUGAG | 5096 |
| UCAGACCUCCGCAGAUGCC | 5097 | GGCAUCUGCGGAGGUCUGA | 5098 |
| CAGACCUCCGCAGAUGCCA | 5099 | UGGCAUCUGCGGAGGUCUG | 5100 |
| GAUGCCAUCUACGACUGCU | 5101 | AGCAGUCGUAGAUGGCAUC | 5102 |
| AUGCCAUCUACGACUGCUC | 5103 | GAGCAGUCGUAGAUGGCAU | 5104 |
| UGCCAUCUACGACUGCUCU | 5105 | AGAGCAGUCGUAGAUGGCA | 5106 |
| GCCAUCUACGACUGCUCUU | 5107 | AAGAGCAGUCGUAGAUGGC | 5108 |
| CCAUCUACGACUGCUCUUC | 5109 | GAAGAGCAGUCGUAGAUGG | 5110 |
| CUACGACUGCUCUUCCCUC | 5111 | GAGGGAAGAGCAGUCGUAG | 5112 |
| UACGACUGCUCUUCCCUCU | 5113 | AGAGGGAAGAGCAGUCGUA | 5114 |
| AUCUCUGGAGUGUAUAAGC | 5115 | GCUUAUACACUCCAGAGAU | 5116 |
| CUGGAGUGUAUAAGCUUCC | 5117 | GGAAGCUUAUACACUCCAG | 5118 |
| UGGAGUGUAUAAGCUUCCU | 5119 | AGGAAGCUUAUACACUCCA | 5120 |
| GGAGUGUAUAAGCUUCCUC | 5121 | GAGGAAGCUUAUACACUCC | 5122 |
| GUAUAAGCUUCCUCCUGAU | 5123 | AUCAGGAGGAAGCUUAUAC | 5124 |
| UAUAAGCUUCCUCCUGAUG | 5125 | CAUCAGGAGGAAGCUUAUA | 5126 |
| AUAAGCUUCCUCCUGAUGA | 5127 | UCAUCAGGAGGAAGCUUAU | 5128 |
| AAGCUUCCUCCUGAUGACU | 5129 | AGUCAUCAGGAGGAAGCUU | 5130 |
| AGCUUCCUCCUGAUGACUU | 5131 | AAGUCAUCAGGAGGAAGCU | 5132 |
| GCUUCCUCCUGAUGACUUC | 5133 | GAAGUCAUCAGGAGGAAGC | 5134 |
| CUUCCUCCUGAUGACUUCC | 5135 | GGAAGUCAUCAGGAGGAAG | 5136 |
| UUCCUCCUGAUGACUUCCU | 5137 | AGGAAGUCAUCAGGAGGAA | 5138 |
| ACUCCUGGGCAGCCCUGA | 5139 | UCAGGGCUGCCCAGGAAGU | 5140 |
| AGACUUCAGGCGGAGGCUG | 5141 | CAGCCUCCGCCUGAAGUCU | 5142 |
| ACUUCAGGCGGAGGCUGGA | 5143 | UCCAGCCUCCGCCUGAAGU | 5144 |
| GCGGAGGCUGGACCAUCAU | 5145 | AUGAUGGUCCAGCCUCCGC | 5146 |
| CGGAGGCUGGACCAUCAUC | 5147 | GAUGAUGGUCCAGCCUCCG | 5148 |
| GGAGGCUGGACCAUCAUCC | 5149 | GGAUGAUGGUCCAGCCUCC | 5150 |
| AAGUGGCCUUGUCUCCUUC | 5151 | GAAGGAGACAAGGCCACUU | 5152 |
| AGUGGCCUUGUCUCCUUCU | 5153 | AGAAGGAGACAAGGCCACU | 5154 |
| GUGGCCUUGUCUCCUUCUA | 5155 | UAGAAGGAGACAAGGCCAC | 5156 |
| CUUGUCUCCUUCUACCGGG | 5157 | CCCGGUAGAAGGAGACAAG | 5158 |
| UUGUCUCCUUCUACCGGGA | 5159 | UCCCGGUAGAAGGAGACAA | 5160 |
| UGUCUCCUUCUACCGGGAC | 5161 | GUCCCGGUAGAAGGAGACA | 5162 |

TABLE 6-continued

| Sense Sequence | SEQ ID NO: | Antisense Sequence | SEQ ID NO: |
|---|---|---|---|
| GUCUCCUUCUACCGGGACU | 5163 | AGUCCCGGUAGAAGGAGAC | 5164 |
| UUCUACCGGGACUGGAAGC | 5165 | GCUUCCAGUCCCGGUAGAA | 5166 |
| UCUACCGGGACUGGAAGCA | 5167 | UGCUUCCAGUCCCGGUAGA | 5168 |
| CUACCGGGACUGGAAGCAG | 5169 | CUGCUUCCAGUCCCGGUAG | 5170 |
| AGCAGGGCUUUGGCAGCAU | 5171 | AUGCUGCCAAAGCCCUGCU | 5172 |
| AGGGCUUUGGCAGCAUCCG | 5173 | CGGAUGCUGCCAAAGCCCU | 5174 |
| GGGCUUUGGCAGCAUCCGU | 5175 | ACGGAUGCUGCCAAAGCCC | 5176 |
| GGCUUUGGCAGCAUCCGUG | 5177 | CACGGAUGCUGCCAAAGCC | 5178 |
| CAUCCACCGGCUCUCCAGA | 5179 | UCUGGAGAGCCGGUGGAUG | 5180 |
| AUCCACCGGCUCUCCAGAC | 5181 | GUCUGGAGAGCCGGUGGAU | 5182 |
| UCCACCGGCUCUCCAGACA | 5183 | UGUCUGGAGAGCCGGUGGA | 5184 |
| AGGACUGGGAGGGCAACCU | 5185 | AGGUUGCCCUCCCAGUCCU | 5186 |
| GCAACCUGCGCUACGCUGA | 5187 | UCAGCGUAGCGCAGGUUGC | 5188 |
| CAACCUGCGCUACGCUGAG | 5189 | CUCAGCGUAGCGCAGGUUG | 5190 |
| CUGCGCUACGCUGAGUAUA | 5191 | UAUACUCAGCGUAGCGCAG | 5192 |
| UGCGCUACGCUGAGUAUAG | 5193 | CUAUACUCAGCGUAGCGCA | 5194 |
| CUACGCUGAGUAUAGCCAC | 5195 | GUGGCUAUACUCAGCGUAG | 5196 |
| UACGCUGAGUAUAGCCACU | 5197 | AGUGGCUAUACUCAGCGUA | 5198 |
| CACUUUGUUUUGGGCAAUG | 5199 | CAUUGCCCAAAACAAAGUG | 5200 |
| AACUACACUGGCAAUGUGG | 5201 | CCACAUUGCCAGUGUAGUU | 5202 |
| ACUACACUGGCAAUGUGGG | 5203 | CCCACAUUGCCAGUGUAGU | 5204 |
| AACGACGCCCUCCAGUAUC | 5205 | GAUACUGGAGGGCGUCGUU | 5206 |
| ACGACGCCCUCCAGUAUCA | 5207 | UGAUACUGGAGGGCGUCGU | 5208 |
| CGACGCCCUCCAGUAUCAU | 5209 | AUGAUACUGGAGGGCGUCG | 5210 |
| GACGCCCUCCAGUAUCAUA | 5211 | UAUGAUACUGGAGGGCGUC | 5212 |
| ACGCCCUCCAGUAUCAUAA | 5213 | UUAUGAUACUGGAGGGCGU | 5214 |
| CGCCCUCCAGUAUCAUAAC | 5215 | GUUAUGAUACUGGAGGGCG | 5216 |
| CAAGUGUGCACAGCUCCGC | 5217 | GCGGAGCUGUGCACACUUG | 5218 |
| AAGUGUGCACAGCUCCGCA | 5219 | UGCGGAGCUGUGCACACUU | 5220 |
| AGUGUGCACAGCUCCGCAA | 5221 | UUGCGGAGCUGUGCACACU | 5222 |
| UGCACAGCUCCGCAAAGGU | 5223 | ACCUUUGCGGAGCUGUGCA | 5224 |
| GCACAGCUCCGCAAAGGUG | 5225 | CACCUUUGCGGAGCUGUGC | 5226 |
| CACAGCUCCGCAAAGGUGG | 5227 | CCACCUUUGCGGAGCUGUG | 5228 |
| ACAGCUCCGCAAAGGUGGC | 5229 | GCCACCUUUGCGGAGCUGU | 5230 |
| CAGCUCCGCAAAGGUGGCU | 5231 | AGCCACCUUUGCGGAGCUG | 5232 |
| AGCUCCGCAAAGGUGGCUA | 5233 | UAGCCACCUUUGCGGAGCU | 5234 |
| GCUCCGCAAAGGUGGCUAC | 5235 | GUAGCCACCUUUGCGGAGC | 5236 |
| CUCCGCAAAGGUGGCUACU | 5237 | AGUAGCCACCUUUGCGGAG | 5238 |
| GCAAAGGUGGCUACUGGUA | 5239 | UACCAGUAGCCACCUUUGC | 5240 |
| CAAAGGUGGCUACUGGUAC | 5241 | GUACCAGUAGCCACCUUUG | 5242 |
| AAAGGUGGCUACUGGUACA | 5243 | UGUACCAGUAGCCACCUUU | 5244 |
| CAACUGCUGCACAGACUCC | 5245 | GGAGUCUGUGCAGCAGUUG | 5246 |
| CACAGACUCCAACCUCAAU | 5247 | AUUGAGGUUGGAGUCUGUG | 5248 |
| ACAGACUCCAACCUCAAUG | 5249 | CAUUGAGGUUGGAGUCUGU | 5250 |
| CAGACUCCAACCUCAAUGG | 5251 | CCAUUGAGGUUGGAGUCUG | 5252 |
| CCAACCUCAAUGGAGUGUA | 5253 | UACACUCCAUUGAGGUUGG | 5254 |
| CAACCUCAAUGGAGUGUAC | 5255 | GUACACUCCAUUGAGGUUG | 5256 |
| AACCUCAAUGGAGUGUACU | 5257 | AGUACACUCCAUUGAGGUU | 5258 |
| ACCUCAAUGGAGUGUACUA | 5259 | UAGUACACUCCAUUGAGGU | 5260 |
| CCUCAAUGGAGUGUACUAC | 5261 | GUAGUACACUCCAUUGAGG | 5262 |
| CUCAAUGGAGUGUACUACC | 5263 | GGUAGUACACUCCAUUGAG | 5264 |
| UCAAUGGAGUGUACUACCG | 5265 | CGGUAGUACACUCCAUUGA | 5266 |
| CAAUGGAGUGUACUACCGC | 5267 | GCGGUAGUACACUCCAUUG | 5268 |
| AAUGGAGUGUACUACCGCC | 5269 | GGCGGUAGUACACUCCAUU | 5270 |
| AUGGAGUGUACUACCGCCU | 5271 | AGGCGGUAGUACACUCCAU | 5272 |
| UGGAGUGUACUACCGCCUG | 5273 | CAGGCGGUAGUACACUCCA | 5274 |
| GGAGUGUACUACCGCCUGG | 5275 | CCAGGCGGUAGUACACUCC | 5276 |
| GAGUGUACUACCGCCUGGG | 5277 | CCCAGGCGGUAGUACACUC | 5278 |
| AGUGUACUACCGCCUGGGU | 5279 | ACCCAGGCGGUAGUACACU | 5280 |
| GUACUACCGCCUGGGUGAG | 5281 | CUCACCCAGGCGGUAGUAC | 5282 |
| UACUACCGCCUGGGUGAGC | 5283 | GCUCACCCAGGCGGUAGUA | 5284 |
| ACUACCGCCUGGGUGAGCA | 5285 | UGCUCACCCAGGCGGUAGU | 5286 |
| CAAUAAGCACCUGGAUGGC | 5287 | GCCAUCCAGGUGCUUAUUG | 5288 |
| AAUAAGCACCUGGAUGGCA | 5289 | UGCCAUCCAGGUGCUUAUU | 5290 |
| AUAAGCACCUGGAUGGCAU | 5291 | AUGCCAUCCAGGUGCUUAU | 5292 |
| UAAGCACCUGGAUGGCAUC | 5293 | GAUGCCAUCCAGGUGCUUA | 5294 |
| AAGCACCUGGAUGGCAUCA | 5295 | UGAUGCCAUCCAGGUGCUU | 5296 |
| AGCACCUGGAUGGCAUCAC | 5297 | GUGAUGCCAUCCAGGUGCU | 5298 |
| GCACCUGGAUGGCAUCACC | 5299 | GGUGAUGCCAUCCAGGUGC | 5300 |
| CACCUGGAUGGCAUCACCU | 5301 | AGGUGAUGCCAUCCAGGUG | 5302 |
| UGGAUGGCAUCACCUGGUA | 5303 | UACCAGGUGAUGCCAUCCA | 5304 |
| UGGCAUGGAUCUACCUACU | 5305 | AGUAGGUAGAUCCAUGCCA | 5306 |
| GGCAUGGAUCUACCUACUC | 5307 | GAGUAGGUAGAUCCAUGCC | 5308 |
| GCAUGGAUCUACCUACUCC | 5309 | GGAGUAGGUAGAUCCAUGC | 5310 |
| CAUGGAUCUACCUACUCCC | 5311 | GGGAGUAGGUAGAUCCAUG | 5312 |
| AUGGAUCUACCUACUCCCU | 5313 | AGGGAGUAGGUAGAUCCAU | 5314 |

TABLE 6-continued

| Sense Sequence | SEQ ID NO: | Antisense Sequence | SEQ ID NO: |
|---|---|---|---|
| UGGAUCUACCUACUCCCUC | 5315 | GAGGGAGUAGGUAGAUCCA | 5316 |
| GGAUCUACCUACUCCCUCA | 5317 | UGAGGGAGUAGGUAGAUCC | 5318 |
| GAUCUACCUACUCCCUCAA | 5319 | UUGAGGGAGUAGGUAGAUC | 5320 |
| AUCUACCUACUCCCUCAAA | 5321 | UUUGAGGGAGUAGGUAGAU | 5322 |
| CGCCCAGAAGACUUCAAGC | 5323 | GCUUGAAGUCUUCUGGGCG | 5324 |
| GCCCAGAAGACUUCAAGCC | 5325 | GGCUUGAAGUCUUCUGGGC | 5326 |
| CCCAGAAGACUUCAAGCCU | 5327 | AGGCUUGAAGUCUUCUGGG | 5328 |
| CCAGAAGACUUCAAGCCUU | 5329 | AAGGCUUGAAGUCUUCUGG | 5330 |
| CAGAAGACUUCAAGCCUUA | 5331 | UAAGGCUUGAAGUCUUCUG | 5332 |
| GAAGACUUCAAGCCUUAAA | 5333 | UUUAAGGCUUGAAGUCUUC | 5334 |
| AAGACUUCAAGCCUUAAAA | 5335 | UUUUAAGGCUUGAAGUCUU | 5336 |
| AGACUUCAAGCCUUAAAAG | 5337 | CUUUUAAGGCUUGAAGUCU | 5338 |
| GACUUCAAGCCUUAAAAGG | 5339 | CCUUUUAAGGCUUGAAGUC | 5340 |
| ACUUCAAGCCUUAAAAGGA | 5341 | UCCUUUUAAGGCUUGAAGU | 5342 |
| CUUCAAGCCUUAAAAGGAG | 5343 | CUCCUUUUAAGGCUUGAAG | 5344 |
| UUCAAGCCUUAAAAGGAGG | 5345 | CCUCCUUUUAAGGCUUGAA | 5346 |
| CCUUAAAAGGAGGCUGCCG | 5347 | CGGCAGCCUCCUUUUAAGG | 5348 |
| CUUAAAAGGAGGCUGCCGU | 5349 | ACGGCAGCCUCCUUUUAAG | 5350 |
| UUAAAAGGAGGCUGCCGUG | 5351 | CACGGCAGCCUCCUUUUAA | 5352 |
| UAAAAGGAGGCUGCCGUGG | 5353 | CCACGGCAGCCUCCUUUUA | 5354 |
| AAAAGGAGGCUGCCGUGGA | 5355 | UCCACGGCAGCCUCCUUUU | 5356 |
| AAAGGAGGCUGCCGUGGAG | 5357 | CUCCACGGCAGCCUCCUUU | 5358 |
| GUGGAGCACGGAUACAGAA | 5359 | UUCUGUAUCCGUGCUCCAC | 5360 |
| ACUGGAUGAGGGCAGAUGA | 5361 | UCAUCUGCCCUCAUCCAGU | 5362 |
| CUGGAUGAGGGCAGAUGAG | 5363 | CUCAUCUGCCCUCAUCCAG | 5364 |
| GGAUGAGGGCAGAUGAGGA | 5365 | UCCUCAUCUGCCCUCAUCC | 5366 |
| AUGAGGGCAGAUGAGGACA | 5367 | UGUCCUCAUCUGCCCUCAU | 5368 |
| UGAGGGCAGAUGAGGACAG | 5369 | CUGUCCUCAUCUGCCCUCA | 5370 |
| AGGGCAGAUGAGGACAGGA | 5371 | UCCUGUCCUCAUCUGCCCU | 5372 |
| GGCAGAUGAGGACAGGAAG | 5373 | CUUCCUGUCCUCAUCUGCC | 5374 |
| CAGAUGAGGACAGGAAGAG | 5375 | CUCUUCCUGUCCUCAUCUG | 5376 |
| GAAUAAGUCUCCAAGGAGC | 5377 | GCUCCUUGGAGACUUAUUC | 5378 |
| AAUAAGUCUCCAAGGAGCA | 5379 | UGCUCCUUGGAGACUUAUU | 5380 |
| AUAAGUCUCCAAGGAGCAC | 5381 | GUGCUCCUUGGAGACUUAU | 5382 |
| GUACCAAGGAUGUUACAGU | 5383 | ACUGUAACAUCCUUGGUAC | 5384 |
| UACCAAGGAUGUUACAGUA | 5385 | UACUGUAACAUCCUUGGUA | 5386 |
| ACCAAGGAUGUUACAGUAA | 5387 | UUACUGUAACAUCCUUGGU | 5388 |
| CCAAGGAUGUUACAGUAAA | 5389 | UUUACUGUAACAUCCUUGG | 5390 |
| CUGGGUCCUGCCACAUCCU | 5391 | AGGAUGUGGCAGGACCCAG | 5392 |
| UGGGUCCUGCCACAUCCUU | 5393 | AAGGAUGUGGCAGGACCCA | 5394 |
| GGGUCCUGCCACAUCCUUC | 5395 | GAAGGAUGUGGCAGGACCC | 5396 |
| GGUCCUGCCACAUCCUUCU | 5397 | AGAAGGAUGUGGCAGGACC | 5398 |
| UCCUGCCACAUCCUUCUCA | 5399 | UGAGAAGGAUGUGGCAGGA | 5400 |
| CCUGCCACAUCCUUCUCAA | 5401 | UUGAGAAGGAUGUGGCAGG | 5402 |
| CUGCCACAUCCUUCUCAAG | 5403 | CUUGAGAAGGAUGUGGCAG | 5404 |
| CUUCUCAAGGUGGUAGACU | 5405 | AGUCUACCACCUUGAGAAG | 5406 |
| AGGUGGUAGACUGAGUGGG | 5407 | CCCACUCAGUCUACCACCU | 5408 |
| GGUCUCUCUGCCCAAGAUC | 5409 | GAUCUUGGGCAGAGAGACC | 5410 |
| GUCUCUCUGCCCAAGAUCC | 5411 | GGAUCUUGGGCAGAGAGAC | 5412 |
| UCUCUCUGCCCAAGAUCCC | 5413 | GGGAUCUUGGGCAGAGAGA | 5414 |
| UCUGCCCAAGAUCCCUGAC | 5415 | GUCAGGGAUCUUGGGCAGA | 5416 |
| CUGCCCAAGAUCCCUGACA | 5417 | UGUCAGGGAUCUUGGGCAG | 5418 |
| UGCCCAAGAUCCCUGACAU | 5419 | AUGUCAGGGAUCUUGGGCA | 5420 |
| GCCCAAGAUCCCUGACAUA | 5421 | UAUGUCAGGGAUCUUGGGC | 5422 |
| CCCAAGAUCCCUGACAUAG | 5423 | CUAUGUCAGGGAUCUUGGG | 5424 |
| AUCCCUGACAUAGCAGUAG | 5425 | CUACUGCUAUGUCAGGGAU | 5426 |
| CCCUGACAUAGCAGUAGCU | 5427 | AGCUACUGCUAUGUCAGGG | 5428 |
| CCUGACAUAGCAGUAGCUU | 5429 | AAGCUACUGCUAUGUCAGG | 5430 |
| CUGACAUAGCAGUAGCUUG | 5431 | CAAGCUACUGCUAUGUCAG | 5432 |
| UGACAUAGCAGUAGCUUGU | 5433 | ACAAGCUACUGCUAUGUCA | 5434 |
| ACAUAGCAGUAGCUUGUCU | 5435 | AGACAAGCUACUGCUAUGU | 5436 |
| CAUAGCAGUAGCUUGUCUU | 5437 | AAGACAAGCUACUGCUAUG | 5438 |
| GCAGUAGCUUGUCUUUUCC | 5439 | GGAAAAGACAAGCUACUGC | 5440 |
| CAGUAGCUUGUCUUUUCCA | 5441 | UGGAAAAGACAAGCUACUG | 5442 |
| AGUAGCUUGUCUUUUCCAC | 5443 | GUGGAAAAGACAAGCUACU | 5444 |
| GUAGCUUGUCUUUUCCACA | 5445 | UGUGGAAAAGACAAGCUAC | 5446 |
| CUUGUCUUUUCCACAUGAU | 5447 | AUCAUGUGGAAAAGACAAG | 5448 |
| UUGUCUUUUCCACAUGAUU | 5449 | AAUCAUGUGGAAAAGACAA | 5450 |
| CUUUUCCACAUGAUUUGUC | 5451 | GACAAAUCAUGUGGAAAAG | 5452 |
| UUUUCCACAUGAUUUGUCU | 5453 | AGACAAAUCAUGUGGAAAA | 5454 |
| UUUCCACAUGAUUUGUCUG | 5455 | CAGACAAAUCAUGUGGAAA | 5456 |
| UUCCACAUGAUUUGUCUGU | 5457 | ACAGACAAAUCAUGUGGAA | 5458 |
| GCUUAGGCUAUGUGAGGGC | 5459 | GCCCUCACAUAGCCUAAGC | 5460 |
| AGGCUAUGUGAGGGCAAAA | 5461 | UUUUGCCCUCACAUAGCCU | 5462 |
| AGGAGUGAAGGAGGCAGGU | 5463 | ACCUGCCUCCUUCACUCCU | 5464 |
| GGAGUGAAGGAGGCAGGUG | 5465 | CACCUGCCUCCUUCACUCC | 5466 |

TABLE 6-continued

| Sense Sequence | SEQ ID NO: | Antisense Sequence | SEQ ID NO: |
|---|---|---|---|
| GAGUGAAGGAGGCAGGUGG | 5467 | CCACCUGCCUCCUUCACUC | 5468 |
| AAUUAUCUUGAGUCUACAC | 5469 | GUGUAGACUCAAGAUAAUU | 5470 |
| ACUCCAGGGCACUGCAUCU | 5471 | AGAUGCAGUGCCCUGGAGU | 5472 |
| CUCCAGGGCACUGCAUCUG | 5473 | CAGAUGCAGUGCCCUGGAG | 5474 |
| AGGGCACUGCAUCUGGCGA | 5475 | UCGCCAGAUGCAGUGCCCU | 5476 |
| GGGCACUGCAUCUGGCGAU | 5477 | AUCGCCAGAUGCAGUGCCC | 5478 |
| GGCACUGCAUCUGGCGAUC | 5479 | GAUCGCCAGAUGCAGUGCC | 5480 |
| GCACUGCAUCUGGCGAUCA | 5481 | UGAUCGCCAGAUGCAGUGC | 5482 |
| CCCUGCUCGCCUUGGUCAU | 5483 | AUGACCAAGGCGAGCAGGG | 5484 |
| CCUGCUCGCCUUGGUCAUG | 5485 | CAUGACCAAGGCGAGCAGG | 5486 |
| CUGCUCGCCUUGGUCAUGU | 5487 | ACAUGACCAAGGCGAGCAG | 5488 |
| UGCUCGCCUUGGUCAUGUA | 5489 | UACAUGACCAAGGCGAGCA | 5490 |
| AUGAAGCACCAGCAGGAGG | 5491 | CCUCCUGCUGGUGCUUCAU | 5492 |
| UGAAGCACCAGCAGGAGGU | 5493 | ACCUCCUGCUGGUGCUUCA | 5494 |
| CAGCAGGAGGUGGACAGAG | 5495 | CUCUGUCCACCUCCUGCUG | 5496 |
| AGCAGGAGGUGGACAGAGU | 5497 | ACUCUGUCCACCUCCUGCU | 5498 |
| GCAGGAGGUGGACAGAGUC | 5499 | GACUCUGUCCACCUCCUGC | 5500 |
| CAGGAGGUGGACAGAGUCU | 5501 | AGACUCUGUCCACCUCCUG | 5502 |
| GGAGGUGGACAGAGUCUCU | 5503 | AGAGACUCUGUCCACCUCC | 5504 |
| AGGUGGACAGAGUCUCUCA | 5505 | UGAGAGACUCUGUCCACCU | 5506 |
| UGGACAGAGUCUCUCAUGG | 5507 | CCAUGAGAGACUCUGUCCA | 5508 |
| GGACAGAGUCUCUCAUGGA | 5509 | UCCAUGAGAGACUCUGUCC | 5510 |
| GACAGAGUCUCUCAUGGAU | 5511 | AUCCAUGAGAGACUCUGUC | 5512 |
| ACAGAGUCUCUCAUGGAUG | 5513 | CAUCCAUGAGAGACUCUGU | 5514 |
| GGAGCUUCCUUUUAAAUUU | 5515 | AAAUUUAAAAGGAAGCUCC | 5516 |
| AACUGAAGGUAGAUGGUGU | 5517 | ACACCAUCUACCUUCAGUU | 5518 |
| ACUGAAGGUAGAUGGUGUU | 5519 | AACACCAUCUACCUUCAGU | 5520 |
| CUGAAGGUAGAUGGUGUUA | 5521 | UAACACCAUCUACCUUCAG | 5522 |
| UGAAGGUAGAUGGUGUUAU | 5523 | AUAACACCAUCUACCUUCA | 5524 |
| GAAGGUAGAUGGUGUUAUA | 5525 | UAUAACACCAUCUACCUUC | 5526 |
| GUAGAUGGUGUUAUAGUUA | 5527 | UAACUAUAACACCAUCUAC | 5528 |
| UGUAAAUAAGCAUCUCACU | 5529 | AGUGAGAUGCUUAUUUACA | 5530 |
| AUAAGCAUCUCACUUUGUA | 5531 | UACAAAGUGAGAUGCUUAU | 5532 |

In some embodiments, the siRNA molecules comprise or consist of the nucleotide sequences (sense and antisense strands) shown in Table 7 and Table 8.

TABLE 7

| Sense Sequence 5' to 3' | SEQ ID NO: | Antisense Sequence 5' to 3' | SEQ ID NO: |
|---|---|---|---|
| ACACUUCCUUGUGUCUAUAGA | 5533 | UCUAUAGACACAAGGAAGUGUCG | 5534 |
| GUACCAGAAGAACUACCGAAA | 5535 | UUUCGGUAGUUCUUCUGGUACAG | 5536 |
| UACCAGAAGAACUACCGAAUA | 5537 | UAUUCGGUAGUUCUUCUGGUACA | 5538 |
| CUGUGACAUGGAAACUUCAGA | 5539 | UCUGAAGUUUCCAUGUCACAGAA | 5540 |
| CAGAAGAACUACCGAAUCUCA | 5541 | UGAGAUUCGGUAGUUCUUCUGGU | 5542 |
| AGAAGAACUACCGAAUCUCUA | 5543 | UAGAGAUUCGGUAGUUCUUCUGG | 5544 |
| GACAGUAUAAGCAAGGGUUUA | 5545 | UAAACCCUUGCUUAUACUGUCUC | 5546 |
| GAAGAACUACCGAAUCUCUGA | 5547 | UCAGAGAUUCGGUAGUUCUUCUG | 5548 |
| UGUGACAUGGAAACUUCAGGA | 5549 | UCCUGAAGUUUCCAUGUCACAGA | 5550 |
| GUCUCCUUCUACCAAGACUGA | 5551 | UCAGUCUUGGUAGAAGGAGACAA | 5552 |
| ACUCUGAGAUGAACAACCAGA | 5553 | UCUGGUUGUUCAUCUCAGAGUAC | 5554 |
| AGACAGUAUAAGCAAGGGUUA | 5555 | UAACCCUUGCUUAUACUGUCUCC | 5556 |
| ACAGUAUAAGCAAGGGUUUGA | 5557 | UCAAACCCUUGCUUAUACUGUCU | 5558 |
| UUGGGCAAUGAACUGAACAGA | 5559 | UCUGUUCAGUUCAUUGCCCAACG | 5560 |
| GCCAACUAUUCCCUCAAACGA | 5561 | UCGUUUGAGGGAAUAGUUGGCUC | 5562 |
| CCGAGCAAGUACUCUGAGA | 5563 | UCUCAGAGUACUUGCUCUCGGCA | 5564 |
| CAUAACAACACCGUCUUCAGA | 5565 | UCUGAAGACGGUGUUGUUAUGGU | 5566 |
| UGUACCAGAAGAACUACCGA | 5567 | UUCGGUAGUUCUUCUGGUACAGG | 5568 |
| UGACAUGGAAACUUCAGGAGA | 5569 | UCUCCUGAAGUUUCCAUGUCACA | 5570 |

TABLE 7-continued

| Sense Sequence 5' to 3' | SEQ ID NO: | Antisense Sequence 5' to 3' | SEQ ID NO: |
|---|---|---|---|
| CUGCAGAAGCCUCAUAAACGA | 5571 | UCGUUUAUGAGGCUUCUGCAGCC | 5572 |
| GCAGAAGCCUCAUAAACGCAA | 5573 | UUGCGUUUAUGAGGCUUCUGCAG | 5574 |
| UGCCGAGAGCAAGUACUCUGA | 5575 | UCAGAGUACUUGCUCUCGGCAGU | 5576 |

TABLE 8

| Sense Sequence 5' to 3' | SEQ ID NO: | Antisense Sequence 5' to 3' | SEQ ID NO: |
|---|---|---|---|
| CUUGGAAGGAAAGCUAUAGGU | 5577 | ACCUAUAGCUUUCCUUCCAAGCC | 5578 |
| UAUAGGCUACCCAUUCAGCUU | 5579 | AAGCUGAAUGGGUAGCCUAUAGC | 5580 |
| GAGACUCAAGCUUUGAGAAAU | 5581 | AUUUCUCAAAGCUUGAGUCUCUG | 5582 |
| GCUAGCAAAGAGCAAGGAAAU | 5583 | AUUUCCUUGCUCUUUGCUAGCCU | 5584 |
| AAGAGAGAAAACAACAAAGUU | 5585 | AACUUUGUUGUUUUCUCUCUUUC | 5586 |
| GUGGCGAGGCCCUCAGAGUGU | 5587 | ACACUCUGAGGGCCUCGCCACUU | 5588 |
| CAGAGUGAAAGCGUAAGGUUU | 5589 | AAACCUUACGCUUUCACUCUGAG | 5590 |
| CGUAAGGUUCAGUCAGCCUGU | 5591 | ACAGGCUGACUGAACCUUACGCU | 5592 |
| CUGCAGCUUUGCAGACCUCAU | 5593 | AUGAGGUCUGCAAAGCUGCAGCA | 5594 |
| CUCAGCUGGGCAUCUCCAGAU | 5595 | AUCUGGAGAUGCCCAGCUGAGGU | 5596 |
| UGAAGGAAGAGCCUUCCUCAU | 5597 | AUGAGGAAGGCUCUUCCUUCAGG | 5598 |
| CACCCAAACCCACAAAAGAU | 5599 | AAUCUUUGUGGGUUUGGGUGAG | 5600 |
| GCCUCUCUCAGCUGUGACCUU | 5601 | AAGGUCACAGCUGAGAGAGGCUU | 5602 |
| UGGCUCUGCAUUUUCAUCGUU | 5603 | AACGAUGAAAAUGCAGAGCCAGG | 5604 |

TABLE 8-continued

| Sense Sequence 5' to 3' | SEQ ID NO: | Antisense Sequence 5' to 3' | SEQ ID NO: |
|---|---|---|---|
| UUUCAUCGUGGCCUUUGUCAU | 5605 | AUGACAAAGGCCACGAUGAAAU | 5606 |
| CUGCAGAAGCUCUCUAAGCAU | 5607 | AUGCUUAGAGAGCUUCUGCAGCC | 5608 |
| AAGCACAAGACACCAGCACAU | 5609 | AUGUGCUGGUGUCUUGUGCUUAG | 5610 |
| CCAGCACAGCCACAGCUCAAU | 5611 | AUUGAGCUGUGGCUGUGCUGGUG | 5612 |
| CAGCUCAAAGCGGCCAACUGU | 5613 | ACAGUUGGCCGCUUUGAGCUGUG | 5614 |
| GCCAACUGCUGUGAGGAGGUU | 5615 | AACCUCCUCACAGCAGUUGGCCG | 5616 |
| GAGGAGGUGAAGGAGCUCAAU | 5617 | AUUGAGCUCCUUCACCUCCUCAC | 5618 |
| GGAGCUCAAGGCCCAAGUUGU | 5619 | ACAACUUGGGCCUUGAGCUCCUU | 5620 |
| CCAAGUUGCCAACCUUAGCAU | 5621 | AUGCUAAGGUUGGCAACUUGGGC | 5622 |
| CUUAGCAGCCUGCUGAGUGAU | 5623 | AUCACUCAGCAGGCUGCUAAGGU | 5624 |
| GCUGAGUGAACUGAACAAGAU | 5625 | AUCUUGUUCAGUUCACUCAGCAG | 5626 |
| UGAACAAGAAGCAGGAGAGGU | 5627 | ACCUCUCCUGCUUCUUGUUCAGU | 5628 |
| GACUGGGUCAGCGUGGUCAUU | 5629 | AAUGACCACGCUGACCCAGUCCC | 5630 |
| GUGGUCAUGCAGGUGAUGGAU | 5631 | AUCCAUCACCUGCAUGACCACGC | 5632 |
| GUGAUGGAGCUGGAGAGCAAU | 5633 | AUUGCUCUCCAGCUCCAUCACCU | 5634 |
| GGAGAGCAACAGCAAGCGCAU | 5635 | AUGCGCUUGCUGUUGCUCUCCAG | 5636 |
| AUGGAGUCGCGGCUCACAGAU | 5637 | AUCUGUGAGCCGCGACUCCAUGC | 5638 |
| CUCACAGAUGCUGAGAGCAAU | 5639 | AUUGCUCUCAGCAUCUGUGAGCC | 5640 |
| GAGCAAGUACUCCGAGAUGAU | 5641 | AUCAUCUCGGAGUACUUGCUCUC | 5642 |

TABLE 8-continued

| Sense Sequence 5' to 3' | SEQ ID NO: | Antisense Sequence 5' to 3' | SEQ ID NO: |
|---|---|---|---|
| CGAGAUGAACAACCAAAUUGU | 5643 | ACAAUUUGGUUGUUCAUCUCGGA | 5644 |
| ACCAAAUUGACAUCAUGCAGU | 5645 | ACUGCAUGAUGUCAAUUUGGUUG | 5646 |
| CAGCUGCAGGCAGCACAGACU | 5647 | AGUCUGUGCUGCCUGCAGCUGCA | 5648 |
| AGCACAGACGGUCACUCAGAU | 5649 | AUCUGAGUGACCGUCUGUGCUGC | 5650 |
| UCACUCAGACCUCCGCAGAUU | 5651 | AAUCUGCGGAGGUCUGAGUGACC | 5652 |
| CGCAGAUGCCAUCUACGACUU | 5653 | AAGUCGUAGAUGGCAUCUGCGGA | 5654 |
| UACGACUGCUCUUCCCUCUAU | 5655 | AUAGAGGGAAGAGCAGUCGUAGA | 5656 |
| UCCCUCUACCAGAAGAACUAU | 5657 | AUAGUUCUUCUGGUAGAGGGAAG | 5658 |
| GAAGAACUACCGCAUCUCUGU | 5659 | ACAGAGAUGCGGUAGUUCUUCUG | 5660 |
| UCUCUGGAGUGUAUAAGCUUU | 5661 | AAAGCUUAUACACUCCAGAGAUG | 5662 |
| CUUCCUCCUGAUGACUUCCUU | 5663 | AAGGAAGUCAUCAGGAGGAAGCU | 5664 |
| AGCCCUGAACUGGAGGUGUUU | 5665 | AAACACCUCCAGUUCAGGGCUGC | 5666 |
| GGAGGUGUUCUGUGACAUGGU | 5667 | ACCAUGUCACAGAACACCUCCAG | 5668 |
| GUGACAUGGAGACUUCAGGCU | 5669 | AGCCUGAAGUCUCCAUGUCACAG | 5670 |
| UCAGGCGGAGGCUGGACCAUU | 5671 | AAUGGUCCAGCCUCCGCCUGAAG | 5672 |
| GACCAUCAUCCAGAGACGAAU | 5673 | AUUCGUCUCUGGAUGAUGGUCCA | 5674 |
| GUGGCCUUGUCUCCUUCUACU | 5675 | AGUAGAAGGAGACAAGGCCACUU | 5676 |
| UCCUUCUACCGGGACUGGAAU | 5677 | AUUCCAGUCCCGGUAGAAGGAGA | 5678 |
| GGACUGGAAGCAGUACAAGCU | 5679 | AGCUUGUACUGCUUCCAGUCCCG | 5680 |
| GGGCUUUGGCAGCAUCCGUGU | 5681 | ACACGGAUGCUGCCAAAGCCCUG | 5682 |
| AACGAACACAUCCACCGGCUU | 5683 | AAGCCGGUGGAUGUGUUCGUUCC | 5684 |
| CCGGCUCUCCAGACAGCCAAU | 5685 | AUUGGCUGUCUGGAGAGCCGGUG | 5686 |
| AGCCAACCCGGCUGCGUGUAU | 5687 | AUACACGCAGCCGGGUUGGCUGU | 5688 |
| CUGCGUGUAGAGAUGGAGGAU | 5689 | AUCCUCCAUCUCUACACGCAGCC | 5690 |
| GAGGACUGGGAGGGCAACCUU | 5691 | AAGGUUGCCCUCCCAGUCCUCCA | 5692 |
| GGCAACCUGCGCUACGCUGAU | 5693 | AUCAGCUAGCGCAGGUUGCCCU | 5694 |
| UACGCUGAGUAUAGCCACUUU | 5695 | AAAGUGGCUAUACUCAGCGUAGC | 5696 |
| UAGCCACUUUGUUUUGGGCAU | 5697 | AUGCCCAAAACAAAGUGGCUAUA | 5698 |
| UUUGGGCAAUGAACUCAACAU | 5699 | AUGUUGAGUUCAUUGCCCAAAAC | 5700 |
| AACAGCUAUCGCCUCUUCCUU | 5701 | AAGGAAGAGGCGAUAGCUGUUGA | 5702 |
| GAACUACACUGGCAAUGUGGU | 5703 | ACCACAUUGCCAGUGUAGUUCCC | 5704 |
| CCUCCAGUAUCAUAACAACAU | 5705 | AUGUUGUUAUGAUACUGGAGGC | 5706 |
| AGCCUUCAGCACCAAGGACAU | 5707 | AUGUCCUUGGUGCUGAAGGCUGU | 5708 |
| AAGGACAAGGACAAUGACAAU | 5709 | AUUGUCAUUGUCCUUGUCCUUGG | 5710 |
| UGACAACUGCUUGGACAAGUU | 5711 | AACUUGUCCAAGCAGUUGUCAUU | 5712 |
| UGGACAAGUGUGCACAGCUCU | 5713 | AGAGCUGUGCACACUUGUCCAAG | 5714 |
| GCUCCGCAAAGGUGGCUACUU | 5715 | AAGUAGCCACCUUUGCGGAGCUG | 5716 |
| UGGCUACUGGUACAACUGCUU | 5717 | AAGCAGUUGUACCAGUAGCCACC | 5718 |

TABLE 8-continued

| Sense Sequence 5' to 3' | SEQ ID NO: | Antisense Sequence 5' to 3' | SEQ ID NO: |
|---|---|---|---|
| GCACAGACUCCAACCUCAAUU | 5719 | AAUUGAGGUUGGAGUCUGUGCAG | 5720 |
| AACCUCAAUGGAGUGUACUAU | 5721 | AUAGUACACUCCAUUGAGGUUGG | 5722 |
| ACUACCGCCUGGGUGAGCACU | 5723 | AGUGCUCACCCAGGCGGUAGUAC | 5724 |
| GGUGAGCACAAUAAGCACCUU | 5725 | AAGGUGCUUAUUGUGCUCACCCA | 5726 |
| UGGAUGGCAUCACCUGGUAUU | 5727 | AAUACCAGGUGAUGCCAUCCAGG | 5728 |
| ACCUGGUAUGGCUGGCAUGGU | 5729 | ACCAUGCCAGCCAUACCAGGUGA | 5730 |
| CUGGCAUGGAUCUACCUACUU | 5731 | AAGUAGGUAGAUCCAUGCCAGCC | 5732 |
| UACCUACUCCCUCAAACGGGU | 5733 | ACCCGUUUGAGGGAGUAGGUAGA | 5734 |
| ACGGGUGGAGAUGAAAAUCCU | 5735 | AGGAUUUUCAUCUCCACCCGUUU | 5736 |
| CCCAGAAGACUUCAAGCCUUU | 5737 | AAAGGCUUGAAGUCUUCUGGGCG | 5738 |
| UCAAGCCUUAAAAGGAGGCUU | 5739 | AAGCCUCCUUUUAAGGCUUGAAG | 5740 |
| AGCACGGAUACAGAAACUGAU | 5741 | AUCAGUUUCUGUAUCCGUGCUCC | 5742 |
| GAGACACGUGGAGACUGGAUU | 5743 | AAUCCAGUCUCCACGUGUCUCAG | 5744 |
| AGACUGGAUGAGGGCAGAUGU | 5745 | ACAUCUGCCCUCAUCCAGUCUCC | 5746 |
| GGCAGAUGAGGACAGGAAGAU | 5747 | AUCUUCCUGUCCUCAUCUGCCCU | 5748 |
| CAGGAAGAGAGUGUUAGAAAU | 5749 | AUUUCUAACACUCUCUUCCUGUC | 5750 |
| GAAAGGGUAGGACUGAGAAAU | 5751 | AUUUCUCAGUCCUACCCUUUCUA | 5752 |
| ACUGAGAAACAGCCUAUAAUU | 5753 | AAUUAUAGGCUGUUUCUCAGUCC | 5754 |
| UCUCCAAAGAAAGAAUAAGUU | 5755 | AACUUAUUCUUUCUUUGGAGAUU | 5756 |
| UAAGUCUCCAAGGAGCACAAU | 5757 | AUUGUGCUCCUUGGAGACUUAUU | 5758 |
| UCAUAUGUACCAAGGAUGUUU | 5759 | AAACAUCCUUGGUACAUAUGAUU | 5760 |
| AAGGAUGUUACAGUAAACAGU | 5761 | ACUGUUUACUGUAACAUCCUUGG | 5762 |
| ACAGGAUGAACUAUUUAAACU | 5763 | AGUUUAAAUAGUUCAUCCUGUUU | 5764 |
| AUUUAAACCCACUGGGUCCUU | 5765 | AAGGACCCAGUGGGUUUAAAUAG | 5766 |
| UGCCACAUCCUUCUCAAGGUU | 5767 | AACCUUGAGAAGGAUGUGGCAGG | 5768 |
| UCUCAAGGUGUAGACUGAGU | 5769 | ACUCAGUCUACCACCUUGAGAAG | 5770 |
| UCUCUCUGCCCAAGAUCCCUU | 5771 | AAGGGAUCUUGGGCAGAGAGACC | 5772 |
| UCCCUGACAUAGCAGUAGCUU | 5773 | AAGCUACUGCUAUGUCAGGGAUC | 5774 |
| GCAGUAGCUUGUCUUUUCCAU | 5775 | AUGGAAAAGACAAGCUACUGCUA | 5776 |
| UCUUUUCCACAUGAUUUGUCU | 5777 | AGACAAAUCAUGUGGAAAGACA | 5778 |
| AUUUGUCUGUGAAAGAAAAUU | 5779 | AAUUUUCUUUCACAGACAAAUCA | 5780 |
| AGAUCGUUUUAUCUAUUUUCU | 5781 | AGAAAAUAGAUAAAACGAUCUCA | 5782 |
| UCUACGGCUUAGGCUAUGUGU | 5783 | ACACAUAGCCUAAGCCGUAGAGA | 5784 |
| GUGAGGGCAAAACACAAAUCU | 5785 | AGAUUUGUGUUUUGCCCUCACAU | 5786 |
| ACACAAAUCCCUUUGCUAAAU | 5787 | AUUUAGCAAAGGGAUUUGUGUUU | 5788 |
| ACCAUAUUAUUUUGAUUCUCU | 5789 | AGAGAAUCAAAAUAAUAUGGUUC | 5790 |
| CUCAAAGGAUAGGCCUUUGAU | 5791 | AUCAAGGCCUAUCCUUUGAGAA | 5792 |
| GCCUUUGAGUGUUAGAGAAAU | 5793 | AUUUCUCUAACACUCAAAGGCCU | 5794 |

TABLE 8-continued

| Sense Sequence 5' to 3' | SEQ ID NO: | Antisense Sequence 5' to 3' | SEQ ID NO: |
|---|---|---|---|
| GAGAAAGGAGUGAAGGAGGCU | 5795 | AGCCUCCUUCACUCCUUUCUCUA | 5796 |
| AGGUGGGAAAUGGUAUUUCUU | 5797 | AAGAAAUACCAUUUCCCACCUGC | 5798 |
| CAGUGAAAUUAUCUUGAGUCU | 5799 | AGACUCAAGAUAAUUCACUGGA | 5800 |
| UUGAGUCUACACAUUAUUUUU | 5801 | AAAAAUAAUGUGUAGACUCAAGA | 5802 |
| AAUUGUUCGGCUGGAACUGAU | 5803 | AUCAGUUCCAGCCGAACAAUUUU | 5804 |
| UGACCCAGGCUGGACUUGCGU | 5805 | ACGCAAGUCCAGCCUGGGUCAGU | 5806 |
| GAGGAAACUCCAGGGCACUGU | 5807 | ACAGUGCCCUGGAGUUUCCUCCC | 5808 |
| GCACUGCAUCUGGCGAUCAGU | 5809 | ACUGAUCGCCAGAUGCAGUGCCC | 5810 |
| GCGAUCAGACUCUGAGCACUU | 5811 | AAGUGCUCAGAGUCUGAUCGCCA | 5812 |
| CGCCUUGGUCAUGUACAGCAU | 5813 | AUGCUGUACAUGACCAAGGCGAG | 5814 |
| CAGCACUGAAAGGAAUGAAGU | 5815 | ACUUCAUUCCUUUCAGUGCUGUA | 5816 |
| GGAAUGAAGCACCAGCAGGAU | 5817 | AUCCUGCUGGUGCUUCAUUCCUU | 5818 |
| CAGCAGGAGGUGGACAGAGUU | 5819 | AACUCUGUCCACCUCCUGCUGGU | 5820 |
| GGACAGAGUCUCUCAUGGAUU | 5821 | AAUCCAUGAGAGACUCUGUCCAC | 5822 |
| CUCAUGGAUGCCGGCACAAAU | 5823 | AUUUGUGCCGGCAUCCAUGAGAG | 5824 |
| GCACAAACUGCCUUAAAAUU | 5825 | AAUUUUAAGGCAGUUUGUGCCG | 5826 |
| UAGUUAUACAGGUAUAUCUU | 5827 | AAGAUAUACCUGUAUUAACUAUG | 5828 |
| CUUUGUAAGAAACAAGCUCAU | 5829 | AUGAGCUUGUUUCUUACAAAGUA | 5830 |
| GGAGCUUCCUUUUAAAUUUUU | 5831 | AAAAAUUUAAAAGGAAGCUCCUU | 5832 |
| CUGUAGGAAAUGGUUGAAAAU | 5833 | AUUUUCAACCAUUUCCUACAGAC | 5834 |
| GUUGAAACUGAAGGUAGAUU | 5835 | AAUCUACCUUCAGUUUUCAACCA | 5836 |
| AAGGUAGAUGGUGUUAUAGUU | 5837 | AACUAUAACACCAUCUACCUUCA | 5838 |
| GUAAAUAAGCAUCUCACUUUU | 5839 | AAAAGUGAGAUGCUUAUUUACAG | 5840 |
| UGGUUUUGUUUUAAACAUUCU | 5841 | AGAAUGUUUAAAACAAAACCACA | 5842 |
| AACAUUCAACGUUUCUUUUCU | 5843 | AGAAAAGAAACGUUGAAUGUUUA | 5844 |
| CUUUUCCUUCUACAAUAAACU | 5845 | AGUUUAUUGUAGAAGGAAAAGAA | 5846 |

The inhibitory nucleic acid molecules disclosed herein can comprise RNA, DNA, or both RNA and DNA. The inhibitory nucleic acid molecules can also be linked or fused to a heterologous nucleic acid sequence, such as in a vector, or a heterologous label. For example, the inhibitory nucleic acid molecules disclosed herein can be within a vector or as an exogenous donor sequence comprising the inhibitory nucleic acid molecule and a heterologous nucleic acid sequence. The inhibitory nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed inhibitory nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The inhibitory nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, —O[(CH$_2$)$_n$O]$_m$CH$_3$, —O(CH$_2$)$_n$OCH$_3$, —O(CH$_2$)$_n$NH$_2$, —O(CH$_2$)$_n$CH$_3$, —O(CH$_2$)$_n$—ONH$_2$, and —O(CH$_2$)$_n$ON[(CH$_2$)$_n$CH$_3$)]$_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as CH$_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:
Sense: mN*mN*/i2FN/mN/i2FN/mN/i2FN/mN/i2FN/mN/i2FN/mN/i2FN/mN/i2FN/mN/i2FN/*mN*/32FN/
Antisense: /52FN/*/i2FN/*mN/i2FN/mN/i2FN/mN/i2FN/mN/i2FN/mN/i2FN/mN/i2FN/mN/i2FN/mN*N*N
wherein: "N" is the base; "2F" is a 2'-F modification; "m" is a 2'-O-methyl modification, "I" is an internal base; and "*" is a phosphorothioate backbone linkage.

The present disclosure also provides vectors comprising any one or more of the inhibitory nucleic acid molecules disclosed herein. In some embodiments, the vectors comprise any one or more of the inhibitory nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

The present disclosure also provides compositions comprising any one or more of the inhibitory nucleic acid molecules disclosed herein. In some embodiments, the composition is a pharmaceutical composition. In some embodiments, the compositions comprise a carrier and/or excipient. Examples of carriers include, but are not limited to, poly (lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

In some embodiments, the ANGPTL7 inhibitor comprises an anti-ANGPTL7 antibody. Antibodies that are specific to ANGPTL7 are described, for example, in U.S. Patent Application Publication Nos. US 2013/0022983 and US 2020/0399640, and in Comes et al., Genes Cells., 2011, 16, 243-259; Xu et al., FASEB J., 2020, 34, 13548-13560, and Kuchtey et al., Invest. Ophthalmol. Vis. Sci., 2008, 49, 3438-3448.

In some embodiments, the ANGPTL7 inhibitor comprises a nuclease agent that induces one or more nicks or double-strand breaks at a recognition sequence(s) or a DNA-binding protein that binds to a recognition sequence within an ANGPTL7 genomic nucleic acid molecule. The recognition sequence can be located within a coding region of the ANGPTL7 gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the ANGPTL7 gene. For example, the recognition sequence can be located about 10, about 20, about 30, about 40, about 50, about 100, about 200, about 300, about 400, about 500, or about 1,000 nucleotides from the start codon. As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30-36 bp for a zinc finger protein or ZFN pair, about 15-18 bp for each ZFN, about 36 bp for a TALE protein or TALEN, and about 20 bp for a CRISPR/Cas guide RNA.

In some embodiments, CRISPR/Cas systems can be used to modify an ANGPTL7 genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of ANGPTL7 nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in an ANGPTL7 genomic nucleic acid molecule or it can be a nickase that creates a single-strand break in an ANGPTL7 genomic nucleic acid molecule. Additional examples of Cas proteins include, but are not limited to, Cas1, Cas1B, Cas2, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of an ANGPTL7 genomic nucleic acid molecules can be generated by contacting a cell with a Cas protein and one or more gRNAs that hybridize to one or more gRNA recognition sequences within a target genomic locus in the ANGPTL7 genomic nucleic acid molecule. For example, a gRNA recognition sequence can be located within a region of SEQ ID NO:1. The gRNA recognition sequence can also include or be proximate to a position corresponding to: position 4,291, position 4,287, position 4,243, position 4,325, or position 4,336 according to SEQ ID NO:1. For example, the gRNA recognition sequence can be located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 4,291, position 4,287, position 4,243, position 4,325, or position 4,336 according to SEQ ID NO:1. The gRNA recognition sequence can include or be proximate to the start codon of an ANGPTL7 genomic nucleic acid molecule or the stop codon of an ANGPTL7 genomic nucleic acid molecule. For example, the gRNA recognition sequence can be located from about 10, from about 20, from about 30, from about 40, from about 50, from about 100, from about 200, from about 300, from about 400, from about 500, or from about 1,000 nucleotides of the start codon or the stop codon.

The gRNA recognition sequences within a target genomic locus in an ANGPTL7 genomic nucleic acid molecule are located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes PAM. In addition, 5'-NGA-3' can be a highly efficient non-canonical PAM for human cells. Generally, the PAM is about 2-6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10, about 2 to about 5 base pairs, or three base pairs upstream or downstream of the PAM sequence. In some embodiments (such as when Cas9 from *S. pyogenes* or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within an ANGPTL7 genomic nucleic acid molecule. An exemplary gRNA is a gRNA effective to direct a Cas enzyme to bind to or cleave an ANGPTL7 genomic nucleic acid molecule, wherein the gRNA comprises a DNA-targeting segment that hybridizes to a gRNA recognition sequence within the ANGPTL7 genomic nucleic acid molecule that includes or is proximate to a position corresponding to: position 4,291, position 4,287, position 4,243, position 4,325, or position 4,336 according to SEQ ID NO:1. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of a position corresponding to: position 4,291, position 4,287, position 4,243, position 4,325, or position 4,336 according to SEQ ID NO:1. Other exemplary gRNAs comprise a DNA-targeting segment that hybridizes to a gRNA recognition sequence present within an ANGPTL7 genomic nucleic acid molecule that includes or is proximate to the start codon or the stop codon. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the start codon or located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs can comprise 20 nucleotides.

Examples of suitable gRNA recognition sequences located within the ANGPTL7 reference gene are set forth in Tables 9-17 as SEQ ID NOs:25-165.

TABLE 9

Guide RNA Recognition Sequences Near ANGPTL7 Arg177Stop Variation

| Strand | Guide RNA Recognition Sequence | SEQ ID NO: |
|---|---|---|
| + | CTGCAGGGACAGGAACAGGTTGG | 25 |
| + | CAGAGTATCCCCTCTGCTTCAGG | 26 |
| + | GGCTCTGCAGGGACAGGAACAGG | 27 |
| + | GCTTCAGGTGTTCTGTGACATGG | 28 |
| + | TGCAGGGACAGGAACAGGTTGGG | 29 |
| + | TCTACTGGCTCTGCAGGGACAGG | 30 |
| − | CCTTCTACCGGGACTGGAAGCAG | 31 |
| − | CCGTGGGGACTTCTGGCTGGGGA | 32 |
| − | CCGGGACTGGAAGCAGTACAAGC | 33 |
| − | CCTTGTCTCCTTCTACCGGGACT | 34 |
| − | CCACCGGCTCTCCAGACAGCCAA | 35 |
| − | CCGGCTCTCCAGACAGCCAACCC | 36 |
| + | TGGAGACTTCAGGCGGAGGCTGG | 37 |
| + | TGTGACATGGAGACTTCAGGCGG | 38 |
| + | TTCTGTGACATGGAGACTTCAGG | 39 |
| + | GACATGGAGACTTCAGGCGGAGG | 40 |
| − | CCATGACTGGACCAGTGCCACCA | 41 |
| − | CCCGGCTGCGTGTAGAGATGGAG | 42 |
| − | CCGGCTGCGTGTAGAGATGGAGG | 43 |
| − | CCAACCCGGCTGCGTGTAGAGAT | 44 |
| − | CCAGGGGCCCCATGACTGGACCA | 45 |
| − | CCCCATGACTGGACCAGTGCCAC | 46 |

TABLE 10

Guide RNA Recognition Sequences Near ANGPTL7 Gln175His Variation

| Strand | Guide RNA Recognition Sequence | SEQ ID NO: |
|---|---|---|
| − | CTGCTTCCAGTCCCGGTAGAAGG | 47 |
| + | TTGTCTCCTTCTACCGGGACTGG | 48 |
| + | GCGGGAGTGCACACATCTACTGG | 49 |
| + | GGACTGGAAGCAGTACAAGCAGG | 50 |
| + | GACATGGAGACTTCAGGCGGAGG | 40 |
| + | GTGGCCTTGTCTCCTTCTACCGG | 51 |
| + | TGGAGACTTCAGGCGGAGGCTGG | 37 |
| − | TACTCTGGTGAGGGACTTGCAGG | 52 |
| − | ACTCTGGTGAGGGACTTGCAGGG | 53 |
| − | GCTTGTACTGCTTCCAGTCCCGG | 53 |
| − | AGTCCCGGTAGAAGGAGACAAGG | 55 |
| + | CACACATCTACTGGCTCTGCAGG | 56 |
| − | CAAGGCCACTTTTTCGTCTATGG | 57 |
| + | GACTGGAAGCAGTACAAGCAGGG | 58 |
| − | GCAGAGGGGATACTCTGGTGAGG | 59 |
| + | CAGAGTATCCCCTCTGCTTCAGG | 26 |
| + | TTCTGTGACATGGAGACTTCAGG | 39 |
| − | CTCTGGTGAGGGACTTGCAGGGG | 60 |
| − | CAGAGGGGATACTCTGGTGAGGG | 61 |
| − | ACTTTTTCGTCTATGGATGATGG | 62 |
| + | TGGCCTTGTCTCCTTCTACCGGG | 63 |
| + | AAGCAGTACAAGCAGGGCTTTGG | 64 |
| + | GCTTCAGGTGTTCTGTGACATGG | 28 |
| − | CTGAAGCAGAGGGGATACTCTGG | 65 |
| − | TCACAGAACACCTGAAGCAGAGG | 66 |
| + | ACACATCTACTGGCTCTGCAGGG | 67 |
| + | ATCATCCATAGACGAAAAAGTGG | 68 |
| + | TGTGACATGGAGACTTCAGGCGG | 38 |
| + | TCTACTGGCTCTGCAGGGACAGG | 30 |

TABLE 11

Guide RNA Recognition Sequences Near ANGPTL7 Arg220His Variation

| Strand | Guide RNA Recognition Sequence | SEQ ID NO: |
|---|---|---|
| + | ATGACCGCGTACAACTCCGGGGG | 69 |
| + | CATGACCGCGTACAACTCCGGGG | 70 |
| − | GGCACCCCCGGAGTTGTACGCGG | 71 |
| − | GAGTTGTACGCGGTCATGTGTGG | 72 |

TABLE 11-continued

Guide RNA Recognition Sequences Near ANGPTL7 Arg220His Variation

| Strand | Guide RNA Recognition Sequence | SEQ ID NO: |
|---|---|---|
| + | ACATGACCGCGTACAACTCCGGG | 73 |
| + | CACATGACCGCGTACAACTCCGG | 74 |
| − | TTGTACGCGGTCATGTGTGGTGG | 75 |
| + | TTGTCTCCTTCTACCGGGACTGG | 48 |
| − | CTGCTTCCAGTCCCGGTAGAAGG | 47 |
| + | TGGGGAACGAACACATCCACCGG | 76 |
| + | GGACTGGAAGCAGTACAAGCAGG | 50 |
| − | GGTGGCACTGGTCCAGTCATGGG | 77 |
| − | CAGAATAGGAATGGCACCCCCGG | 78 |
| − | GTGGCACTGGTCCAGTCATGGGG | 79 |
| − | GCGGTCATGTGTGGTGGCACTGG | 80 |
| − | TGGTGGCACTGGTCCAGTCATGG | 81 |
| + | GTGGCCTTGTCTCCTTCTACCGG | 51 |
| + | GCAGCATCCGTGGGGACTTCTGG | 82 |
| + | CATCCGTGGGGACTTCTGGCTGG | 83 |
| − | GCTTGTACTGCTTCCAGTCCCGG | 54 |
| − | AGTCCCGGTAGAAGGAGACAAGG | 55 |
| + | GGCTCTCCAGACAGCCAACCCGG | 84 |
| + | ATCCGTGGGGACTTCTGGCTGGG | 85 |
| + | GACTGGAAGCAGTACAAGCAGGG | 58 |
| − | TTGGCTGTCTGGAGAGCCGGTGG | 86 |
| − | TGGTCCAGTCATGGGGCCCCTGG | 86 |
| − | GATTTGTCTTGAATCAGAATAGG | 88 |
| + | AACCCGGCTGCATGTAGAGATGG | 89 |
| − | CTCCATCTCTACATGCAGCCGGG | 90 |
| + | TGGCCTTGTCTCCTTCTACCGGG | 63 |
| + | AAGCAGTACAAGCAGGGCTTTGG | 64 |
| + | TAGAGATGGAGGTAAGCACAAGG | 91 |
| + | TCCGTGGGGACTTCTGGCTGGGG | 92 |

TABLE 12

Guide RNA Recognition Sequences Near ANGPTL7 Arg220Cys Variation

| Strand | Guide RNA Recognition Sequence | SEQ ID NO: |
|---|---|---|
| + | ATGACCGCGTACAACTCCGGGGG | 69 |
| + | CATGACCGCGTACAACTCCGGGG | 70 |
| − | GGCACCCCCGGAGTTGTACGCGG | 71 |

TABLE 12-continued

Guide RNA Recognition Sequences Near ANGPTL7 Arg220Cys Variation

| Strand | Guide RNA Recognition Sequence | SEQ ID NO: |
|---|---|---|
| − | GAGTTGTACGCGGTCATGTGTGG | 72 |
| + | ACATGACCGCGTACAACTCCGGG | 73 |
| + | CACATGACCGCGTACAACTCCGG | 74 |
| − | TTGTACGCGGTCATGTGTGGTGG | 75 |
| + | TTGTCTCCTTCTACCGGGACTGG | 48 |
| − | CTGCTTCCAGTCCCGGTAGAAGG | 47 |
| + | TGGGGAACGAACACATCCACCGG | 76 |
| + | GGACTGGAAGCAGTACAAGCAGG | 50 |
| − | GGTGGCACTGGTCCAGTCATGGG | 77 |
| − | CAGAATAGGAATGGCACCCCCGG | 78 |
| − | GTGGCACTGGTCCAGTCATGGGG | 79 |
| − | GCGGTCATGTGTGGTGGCACTGG | 80 |
| − | TGGTGGCACTGGTCCAGTCATGG | 81 |
| + | CATCCGTGGGGACTTCTGGCTGG | 83 |
| + | GCAGCATCCGTGGGGACTTCTGG | 82 |
| + | GTGGCCTTGTCTCCTTCTACCGG | 51 |
| − | GCTTGTACTGCTTCCAGTCCCGG | 54 |
| + | GGCTCTCCAGACAGCCAACCCGG | 84 |
| − | AGTCCCGGTAGAAGGAGACAAGG | 55 |
| + | ATCCGTGGGGACTTCTGGCTGGG | 85 |
| + | GACTGGAAGCAGTACAAGCAGGG | 58 |
| − | TGGTCCAGTCATGGGGCCCCTGG | 87 |
| − | TTGGCTGTCTGGAGAGCCGGTGG | 86 |
| − | GATTTGTCTTGAATCAGAATAGG | 88 |
| − | ATCTCTACACACAGCCGGGTTGG | 93 |
| + | AAGCAGTACAAGCAGGGCTTTGG | 64 |
| + | TGGCCTTGTCTCCTTCTACCGGG | 63 |
| + | TAGAGATGGAGGTAAGCACAAGG | 91 |
| + | TCCGTGGGGACTTCTGGCTGGGG | 92 |
| + | AACCCGGCTGTGTGTAGAGATGG | 94 |
| − | CCTCCATCTCTACACACAGCCGG | 95 |

TABLE 13

Guide RNA Recognition Sequences Near ANGPTL7 Asn302Lys Variation

| Strand | Guide RNA Recognition Sequence | SEQ ID NO: |
|---|---|---|
| + | CAATGGAGTGTACTACCGCCTGG | 96 |
| + | AATGGAGTGTACTACCGCCTGGG | 97 |

TABLE 13-continued

Guide RNA Recognition Sequences Near ANGPTL7 Asn302Lys Variation

| Strand | Guide RNA Recognition Sequence | SEQ ID NO: |
|---|---|---|
| + | TACCTACTCCCTCAAACGGTGG | 98 |
| − | TTTCATCTCCACCCGTTTGAGGG | 99 |
| + | ACAGTCAACTTACTAGCACTGGG | 100 |
| − | TTTTCATCTCCACCCGTTTGAGG | 101 |
| + | GGGTGAGCACAATAAGCACCTGG | 102 |
| + | ATGGCATCACCTGGTATGGCTGG | 103 |
| − | CTCCACCCGTTTGAGGGAGTAGG | 104 |
| − | GGTGCTTATTGTGCTCACCCAGG | 105 |
| + | CTAACTCCTTACCTGATGTCTGG | 106 |
| + | CACAGTCAACTTACTAGCACTGG | 107 |
| − | CAGTTGTACCAGTAGCCACCTGG | 108 |
| − | GATAGACCAGACATCAGGTAAGG | 109 |
| − | TCAGGTAAGGAGTTAGAGCCAGG | 110 |
| + | GATCTACCTACTCCCTCAAACGG | 111 |
| − | AGATCCATGCCAGCCATACCAGG | 112 |
| − | GCTTATTGTGCTCACCCAGGCGG | 113 |
| − | CATACCAGGTGATGCCATCCAGG | 114 |
| + | ATCTACCTACTCCCTCAAACGGG | 115 |
| − | ACTGTGATAGACCAGACATCAGG | 116 |
| + | TTCTCATGCCAGGTGGCTACTGG | 117 |
| + | CTGGATGGCATCACCTGGTATGG | 118 |
| + | AGCACCTGGATGGCATCACCTGG | 119 |
| + | ATCACCTGGTATGGCTGGCATGG | 120 |
| − | GTAGTACACTCCATTGAGTTTGG | 121 |
| + | GAGCACAATAAGCACCTGGATGG | 122 |
| − | CAGGTAAGGAGTTAGAGCCAGGG | 123 |
| + | CTGGGTCTGTTTCTCATGCCAGG | 124 |
| + | TTTGGTATTCTTTCTGACCCTGG | 125 |
| − | GTCAGAAAGAATACCAAAACCGG | 126 |
| + | GGTCTGTTTCTCATGCCAGGTGG | 127 |

TABLE 14

Guide RNA Recognition Sequences Near ANGPTL7 Arg340His Variation

| Strand | Guide RNA Recognition Sequence | SEQ ID NO: |
|---|---|---|
| + | CAATGGAGTGTACTACCGCCTGG | 96 |
| + | AATGGAGTGTACTACCGCCTGGG | 97 |

TABLE 14-continued

Guide RNA Recognition Sequences
Near ANGPTL7 Arg340His Variation

| Strand | Guide RNA Recognition Sequence | SEQ ID NO: |
|---|---|---|
| − | GGCGGTAGTACACTCCATTGAGG | 128 |
| + | TACCTACTCCCTCAAACGGGTGG | 98 |
| − | GTAGTACACTCCATTGAGGTTGG | 129 |
| − | TTTCATCTCCACCCGTTTGAGGG | 99 |
| − | TTTTCATCTCCACCCGTTTGAGG | 101 |
| + | GGGTGAGCACAATAAGCACCTGG | 102 |
| + | ATGGCATCACCTGGTATGGCTGG | 103 |
| − | GGTGCTTATTGTGCTCACCCAGG | 105 |
| − | CTCCACCCGTTTGAGGGAGTAGG | 104 |
| − | GTTTCTGTATCCGTGCTCCACGG | 130 |
| + | AAACTGAGACACGTGGAGACTGG | 131 |
| − | GCTTATTGTGCTCACCCAGGCGG | 113 |
| + | GATCTACCTACTCCCTCAAACGG | 111 |
| − | AGATCCATGCCAGCCATACCAGG | 112 |
| + | GCCTTAAAAGGAGGCTGCCGTGG | 132 |
| − | CATACCAGGTGATGCCATCCAGG | 114 |
| + | ATCTACCTACTCCCTCAAACGGG | 115 |
| + | GACACGTGGAGACTGGATGAGGG | 133 |
| − | TCCACGGCAGCCTCCTTTTAAGG | 134 |
| + | CTGGATGGCATCACCTGGTATGG | 118 |
| + | AGCACCTGGATGGCATCACCTGG | 119 |
| + | ATCACCTGGTATGGCTGGCATGG | 120 |
| + | TGCACAGACTCCAACCTCAATGG | 135 |
| + | GAGCACAATAAGCACCTGGATGG | 122 |
| + | AGACACGTGGAGACTGGATGAGG | 136 |
| + | AGACTTCAAGCCTTAAAAGGAGG | 137 |
| − | TTTAAGGCTTGAAGTCTTCTGGG | 138 |
| − | AAGGCTTGAAGTCTTCTGGGTGG | 139 |
| − | TTTTAAGGCTTGAAGTCTTCTGG | 140 |
| + | GATACAGAAACTGAGACACGTGG | 141 |
| + | AAGGAGGCTGCCGTGGAGCACGG | 142 |
| + | AGAAGACTTCAAGCCTTAAAAGG | 143 |

TABLE 15

Guide RNA Recognition Sequences
Near ANGPTL7 Phe161Ile Variation

| Strand | Guide RNA Recognition Sequence | SEQ ID NO: |
|---|---|---|
| − | ACAGAACACCTGAAGCAGAGGGG | 144 |
| − | ACAGAACACCTGAAGCAGAGGGG | 145 |
| − | CACAGAACACCTGAAGCAGAGGG | 146 |
| + | CAGAGTATCCCCTCTGCTTCAGG | 147 |
| − | ACTCTGGTGAGGGACTTGCAGGG | 148 |
| − | TACTCTGGTGAGGGACTTGCAGG | 149 |
| − | GCAGAGGGGATACTCTGGTGAGG | 150 |
| + | GCTTCAGGTGTTCTGTGACATGG | 151 |
| − | CAGAGGGGATACTCTGGTGAGGG | 152 |

TABLE 16

Guide RNA Recognition Sequences
Near ANGPTL7 Trp188STOP Variation

| Strand | Guide RNA Recognition Sequence | SEQ ID NO: |
|---|---|---|
| + | TTGTCTCCTTCTACCGGGACTGG | 153 |
| + | GTGGCCTTGTCTCCTTCTACCGG | 154 |
| + | TGGCCTTGTCTCCTTCTACCGGG | 155 |
| + | GACTGGAAGCAGTACAAGCAGGG | 156 |
| + | GGACTGGAAGCAGTACAAGCAGG | 157 |
| − | CTGCTTCCAGTCCCGGTAGAAGG | 158 |
| − | GCTTGTACTGCTTCCAGTCCCGG | 159 |
| − | AGTCCCGGTAGAAGGAGACAAGG | 160 |

TABLE 17

Guide RNA Recognition Sequences
Near ANGPTL7 Lys192Gln Variation

| Strand | Guide RNA Recognition Sequence | SEQ ID NO: |
|---|---|---|
| + | GACTGGAAGCAGTACAAGCAGGG | 156 |
| + | GGACTGGAAGCAGTACAAGCAGG | 157 |
| − | GGACTGGAAGCAGTACAAGC | 159 |
| + | AAGCAGTACAAGCAGGGCTTTGG | 161 |
| + | CAGGGCTTTGGCAGCATCCGTGG | 162 |
| + | AGGGCTTTGGCAGCATCCGTGGG | 163 |
| + | GGGCTTTGGCAGCATCCGTGGGG | 164 |
| − | TCCCCAGCCAGAAGTCCCCACGG | 165 |

The Cas protein and the gRNA form a complex, and the Cas protein cleaves the target ANGPTL7 genomic nucleic acid molecule. The Cas protein can cleave the nucleic acid molecule at a site within or outside of the nucleic acid sequence present in the target ANGPTL7 genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the ANGPTL7 genomic nucleic acid molecule to which a DNA-targeting segment of a gRNA will bind.

Such methods can result, for example, in an ANGPTL7 genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the ANGPTL7 genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In any of the embodiments described herein, the subject can also be treated with a therapeutic agent that treats or inhibits an ophthalmic condition. Such therapeutic agents include, but are not limited to, a prostaglandin, a beta blocker, an alpha-adrenergic agonist, a carbonic anhydrase inhibitor, a rho kinase inhibitor, or a miotic or cholinergic agent. In some embodiments, the therapeutic agent that treats or inhibits the ophthalmic condition is a prostaglandin. In some embodiments, the prostaglandin is XALATAN® (latanoprost), TRAVATAN Z® (travoprost), ZIOPTAN® (tafluprost), LUMIGAN® (bimatoprost), or VYZULTA® (latanoprostene bunod). In some embodiments, the prostaglandin is latanoprost, travoprost, tafluprost, bimatoprost, or latanoprostene bunod. In some embodiments, the therapeutic agent that treats or inhibits the ophthalmic condition is a beta blocker. In some embodiments, the beta blocker is BETIMOL®, ISTALOL®, or TIMOPTIC® (timolol) or BETOPTIC® (betaxolol). In some embodiments, the beta blocker is timolol or betaxolol. In some embodiments, the therapeutic agent that treats or inhibits the ophthalmic condition is an alpha-adrenergic agonist. In some embodiments, the alpha-adrenergic agonist is IOPIDINE® (apraclonidine) or ALPHAGAN® or QOLIANA® (brimonidine). In some embodiments, the alpha-adrenergic agonist is apraclonidine or brimonidine. In some embodiments, the therapeutic agent that treats or inhibits the ophthalmic condition is a carbonic anhydrase inhibitor. In some embodiments, the carbonic anhydrase inhibitor is TRUSOPT® (dorzolamide) or AZOPT® (brinzolamide). In some embodiments, the carbonic anhydrase inhibitor is dorzolamide or brinzolamide. In some embodiments, the therapeutic agent that treats or inhibits the ophthalmic condition is a rho kinase inhibitor. In some embodiments, the rho kinase inhibitor is RHOPRESSA® (netarsudil). In some embodiments, the rho kinase inhibitor is netarsudil. In some embodiments, the therapeutic agent that treats or inhibits the ophthalmic condition is a miotic or cholinergic agent. In some embodiments, the miotic or cholinergic agent is ISOPTO® Carpine (pilocarpine). In some embodiments, the miotic or cholinergic agent is pilocarpine.

In some embodiments, the methods of treatment further comprise detecting the presence or absence of an ANGPTL7 predicted loss-of-function variant nucleic acid molecule encoding an ANGPTL7 polypeptide in a biological sample from the subject. As used throughout the present disclosure, "an ANGPTL7 predicted loss-of-function variant nucleic acid molecule" is any ANGPTL7 nucleic acid molecule (such as, for example, genomic nucleic acid molecule, mRNA molecule, or cDNA molecule) encoding an ANGPTL7 polypeptide having a partial loss-of-function, a complete loss-of-function, a predicted partial loss-of-function, or a predicted complete loss-of-function.

The present disclosure also provides methods of treating a subject undergoing glucocorticoid treatment. In some embodiments, the subject is suffering from inflammation. In some embodiments, the methods comprise determining whether the subject has an ANGPTL7 predicted loss-of-function variant nucleic acid molecule encoding an ANGPTL7 polypeptide. In some embodiments, the determining step comprises obtaining or having obtained a biological sample from the subject, and performing or having performed a sequence analysis on the biological sample to determine if the subject has a genotype comprising the ANGPTL7 predicted loss-of-function variant nucleic acid molecule. In some embodiments, the methods comprise administering or continuing to administer to a subject that is ANGPTL7 reference the glucocorticoid in a standard dosage amount, and administering an ANGPTL7 inhibitor to the subject. In some embodiments, the methods comprise administering or continuing to administer to a subject that is heterozygous for the ANGPTL7 predicted loss-of-function variant the glucocorticoid in an amount that is the same as or higher than a standard dosage amount, and administering an ANGPTL7 inhibitor to the subject. In some embodiments, the methods comprise administering or continuing to administer to a subject that is homozygous for the ANGPTL7 predicted loss-of-function variant the glucocorticoid in an amount that is the same as or higher than a standard dosage amount. The presence of a genotype having the ANGPTL7 predicted loss-of-function variant nucleic acid molecule encoding the ANGPTL7 polypeptide indicates the subject has a decreased risk of developing a glucocorticoid-induced ophthalmic condition. In some embodiments, the subject is ANGPTL7 reference. In some embodiments, the subject is heterozygous for the ANGPTL7 predicted loss-of-function variant.

In some embodiments, the subject is ANGPTL7 reference, and the subject is administered or continued to be administered the glucocorticoid in a standard dosage amount, and is administered an ANGPTL7 inhibitor. In some embodiments, the subject is heterozygous for an ANGPTL7 predicted loss-of-function variant, and the subject is administered or continued to be administered the glucocorticoid in an amount that is the same as or higher than a standard dosage amount, and is administered an ANGPTL7 inhibitor. In some embodiments, the subject is homozygous for an ANGPTL7 predicted loss-of-function variant, and the subject is administered or continued to be administered the glucocorticoid in an amount that is the same as or higher than a standard dosage amount.

Detecting the presence or absence of an ANGPTL7 predicted loss-of-function variant nucleic acid molecule in a biological sample from a subject and/or determining whether a subject has an ANGPTL7 predicted loss-of-function variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

The present disclosure also provides methods of treating a subject undergoing glucocorticoid treatment. In some embodiments, the subject is suffering from inflammation. In some embodiments, the methods comprise determining whether the subject has an ANGPTL7 predicted loss-of-function variant polypeptide. In some embodiments, the determining step comprises obtaining or having obtained a biological sample from the subject, and performing or having performed an assay on the biological sample to determine if the subject has an ANGPTL7 predicted loss-of-function variant polypeptide. In some embodiments, the methods comprise administering or continuing to administer to a subject that does not have an ANGPTL7 predicted loss-of-function variant polypeptide the glucocorticoid in a standard dosage amount, and administering an ANGPTL7 inhibitor to the subject. In some embodiments, the methods comprise administering or continuing to administer to a subject that has the ANGPTL7 predicted loss-of-function variant polypeptide the glucocorticoid in an amount that is the same as or higher than a standard dosage amount. The presence of an ANGPTL7 predicted loss-of-function variant polypeptide indicates the subject does not have an increased risk of developing a glucocorticoid-induced ophthalmic condition. In some embodiments, the subject has an ANGPTL7 predicted loss-of-function variant polypeptide. In some embodiments, the subject does not have an ANGPTL7 predicted loss-of-function variant polypeptide.

Detecting the presence or absence of an ANGPTL7 predicted loss-of-function polypeptide in a biological sample from a subject and/or determining whether a subject has an ANGPTL7 predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the polypeptide can be present within a cell obtained from the subject.

In some embodiments, the dose of the glucocorticoids can be increased by about 10%, by about 20%, by about 30%, by about 40%, by about 50%, by about 60%, by about 70%, by about 80%, or by about 90% for subjects that are heterozygous or homozygous for an ANGPTL7 predicted loss-of-function variant (i.e., a higher than the standard dosage amount) compared to subjects that are ANGPTL7 reference (who may receive a standard dosage amount). In some embodiments, the dose of the glucocorticoids can be increased by about 10%, by about 20%, by about 30%, by about 40%, or by about 50%. In addition, the dose of glucocorticoids in subjects that are heterozygous or homozygous for an ANGPTL7 predicted loss-of-function variant can be administered more frequently compared to subjects that are ANGPTL7 reference.

Administration of the glucocorticoids and/or ANGPTL7 inhibitors can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more.

Administration of the glucocorticoids and/or ANGPTL7 inhibitors can occur by any suitable route including, but not limited to, parenteral, intravenous, oral, subcutaneous, intraarterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

Administration of the glucocorticoids and/or ANGPTL7 inhibitors can be administered in a single dosage form or as separate dosage forms. When administered as separate dosage forms, the glucocorticoids can be administered concurrently with or sequentially to ANGPTL7 inhibitors. In some embodiments, the glucocorticoids and ANGPTL7 inhibitors are administered concurrently. In some embodiments, the glucocorticoids and ANGPTL7 inhibitors are administered sequentially. For example, in some embodiments, the glucocorticoids can be administered prior to the ANGPTL7 inhibitors. In some embodiments, the ANGPTL7 inhibitors are administered prior to the glucocorticoids.

The terms "treat", "treating", and "treatment" and "prevent", "preventing", and "prevention" as used herein referring to inflammation, refer to eliciting the desired biological response, such as a therapeutic and prophylactic effect, respectively. In some embodiments, a therapeutic effect comprises one or more of a decrease/reduction in inflammation, a decrease/reduction in the severity of inflammation (such as, for example, a reduction or inhibition of development of inflammation), a decrease/reduction in symptoms and inflammation-related effects, delaying the onset of symptoms and inflammation-related effects, reducing the severity of symptoms of inflammation-related effects, reducing the severity of an acute episode, reducing the number of symptoms and inflammation-related effects, reducing the latency of symptoms and inflammation-related effects, an amelioration of symptoms and inflammation-related effects, reducing secondary symptoms, reducing secondary infections, preventing relapse to inflammation, decreasing the number or frequency of relapse episodes, increasing latency between symptomatic episodes, increasing time to sustained progression, speeding recovery, and/or increasing efficacy of or decreasing resistance to alternative therapeutics, following administration of the glucocorticoid or composition comprising the glucocorticoid. A prophylactic effect may comprise a complete or partial avoidance/inhibition or a delay of inflammation development/progression (such as, for example, a complete or partial avoidance/inhibition or a delay) following administration of a therapeutic protocol. Treatment of inflammation encompasses the treatment of subjects already diagnosed as having any form of inflammation at any clinical stage or manifestation, the delay of the onset or evolution or aggravation or deterioration of the symptoms or signs of inflammation, and/or preventing and/or reducing the severity of inflammation.

The terms "treat", "treating", and "treatment" and "prevent", "preventing", and "prevention" as used herein referring to glucocorticoid-induced ophthalmic conditions, refer to eliciting the desired biological response, such as a therapeutic and prophylactic effect, respectively. In some embodiments, a therapeutic effect comprises one or more of a decrease/reduction in a glucocorticoid-induced ophthalmic condition, a decrease/reduction in the severity of a glucocorticoid-induced ophthalmic condition (such as, for example, a reduction or inhibition of development of a glucocorticoid-induced ophthalmic condition), a decrease/reduction in symptoms and a glucocorticoid-induced ophthalmic condition-related effects, delaying the onset of symptoms and a glucocorticoid-induced ophthalmic condition-related effects, reducing the severity of symptoms of a glucocorticoid-induced ophthalmic condition-related effects, reducing the severity of an acute episode, reducing the number of symptoms and a glucocorticoid-induced ophthalmic condition-related effects, reducing the latency of symptoms and a glucocorticoid-induced ophthalmic condition-related effects, an amelioration of symptoms and a glucocorticoid-induced ophthalmic condition-related effects, reducing secondary symptoms, preventing relapse to a glucocorticoid-induced ophthalmic condition, decreasing the number or frequency of relapse episodes, increasing latency between symptomatic episodes, increasing time to sustained progression, speeding recovery, and/or increasing efficacy of or decreasing resistance to alternative therapeutics, following administration of the ANGPTL7 inhibitor or composition comprising the ANGPTL7 inhibitor. A prophylactic effect may comprise a complete or partial avoidance/inhibition or a delay of a glucocorticoid-induced ophthalmic condition development/progression (such as, for example, a complete or partial avoidance/inhibition or a delay) following administration of an ANGPTL7 inhibitor. Treatment of a glucocorticoid-induced ophthalmic condition encompasses the treatment of subjects already diagnosed as having any form of a glucocorticoid-induced ophthalmic condition at any clinical stage or manifestation, the delay of the onset or evolution or aggravation or deterioration of the symptoms or signs of a glucocorticoid-induced ophthalmic condition, and/or preventing and/or reducing the severity of a glucocorticoid-induced ophthalmic condition.

The present disclosure also provides methods of identifying a subject undergoing glucocorticoid treatment having an increased risk for developing a glucocorticoid-induced ophthalmic condition. In some embodiments, the methods comprise determining or having determined the presence or absence of an ANGPTL7 predicted loss-of-function variant nucleic acid molecule encoding an ANGPTL7 polypeptide in a biological sample obtained from the subject. When the subject is ANGPTL7 reference, then the subject has an increased risk for developing the glucocorticoid-induced ophthalmic condition. When the subject is heterozygous or homozygous for an ANGPTL7 predicted loss-of-function variant, then the subject does not have an increased risk for developing the glucocorticoid-induced ophthalmic condition.

Having a single copy of an ANGPTL7 predicted loss-of-function variant nucleic acid molecule is more protective of a subject undergoing glucocorticoid treatment from developing a glucocorticoid-induced ophthalmic condition than having no copies of an ANGPTL7 predicted loss-of-function variant nucleic acid molecule. Without intending to be limited to any particular theory or mechanism of action, it is believed that a single copy of an ANGPTL7 predicted loss-of-function variant nucleic acid molecule (i.e., heterozygous for an ANGPTL7 predicted loss-of-function variant) is protective of a subject undergoing glucocorticoid treatment from developing a glucocorticoid-induced ophthalmic condition, and it is also believed that having two copies of an ANGPTL7 predicted loss-of-function variant nucleic acid molecule (i.e., homozygous for an ANGPTL7 predicted loss-of-function variant nucleic acid molecule) may be more protective of a subject undergoing glucocorticoid treatment from developing a glucocorticoid-induced ophthalmic condition, relative to a subject with a single copy. Thus, in some embodiments, a single copy of an ANGPTL7 predicted loss-of-function variant nucleic acid molecule may not be completely protective, but instead, may be partially or incompletely protective of a subject undergoing glucocorticoid treatment from developing a glucocorticoid-induced ophthalmic condition. While not desiring to be bound by any particular theory, there may be additional factors or molecules involved in the development of a glucocorticoid-induced ophthalmic condition that are still present in a subject having a single copy of an ANGPTL7 predicted loss-of-function variant nucleic acid molecule, thus resulting in less than complete protection from the development of a glucocorticoid-induced ophthalmic condition.

In some embodiments, the subject can have inflammation. In some embodiments, the inflammation can be acute inflammation or chronic inflammation. In some embodiments, the inflammation is acute inflammation. In some embodiments, the inflammation is chronic inflammation. In some embodiments, the inflammation is associated with rheumatoid arthritis, associated with Grave's disease, or is ophthalmic inflammation. In some embodiments, the inflammation is associated with rheumatoid arthritis. In some embodiments, the inflammation is associated with Grave's disease. In some embodiments, the inflammation is ophthalmic inflammation. In some embodiments, the ophthalmic inflammation is chosen from uveitis, juvenile idiopathic arthritis uveitis, scleritis, blepharitis, conjunctivitis, iritis, and episcleritis, or any combination thereof. In some embodiments, the ophthalmic inflammation is uveitis. In some embodiments, the ophthalmic inflammation is juvenile idiopathic arthritis uveitis. In some embodiments, the ophthalmic inflammation is scleritis. In some embodiments, the ophthalmic inflammation is blepharitis. In some embodiments, the ophthalmic inflammation is conjunctivitis. In some embodiments, the ophthalmic inflammation is iritis. In some embodiments, the ophthalmic inflammation is episcleritis.

In some embodiments, the glucocorticoid-induced ophthalmic condition is chosen from ocular hypertension, increased intraocular pressure (IOP), pre-glaucoma, glaucoma, decreased corneal hysteresis, and posterior subcapsular cataracts, or any combination thereof. In some embodiments, the glucocorticoid-induced ophthalmic condition is ocular hypertension. In some embodiments, the glucocorticoid-induced ophthalmic condition is increased IOP. In some embodiments, the glucocorticoid-induced ophthalmic condition is pre-glaucoma. In some embodiments, the glucocorticoid-induced ophthalmic condition is glaucoma. In some embodiments, the glucocorticoid-induced ophthalmic condition is decreased corneal hysteresis. In some embodiments, the glucocorticoid-induced ophthalmic condition is posterior subcapsular cataracts.

In some embodiments, the glucocorticoid treatment is treatment with prednisone, prednisolone, methylprednisolone, dexamethasone, betamethasone, triamcinolone, beclometasone, fludrocortisone acetate, DOCA, aldosterone, budesonide, mometasone furoate, fluticasone propionate, hydrocortisone, cortisone acetate, or fluticasone furoate, difluprednate ophthalmic, fluorometholone, loteprednol etabonate, medrysone, rimexolone, fluocinolone acetonide, clobetasol, halobetasol, diflorasone, fluocinonide, flurandrenolide, Neo-Poly-Dex, tobramycin-dexamethasone, difluprednate, or any combination thereof. In some embodiments, the glucocorticoid treatment is treatment with prednisone. In some embodiments, the glucocorticoid treatment is treatment with prednisolone. In some embodiments, the glucocorticoid treatment is treatment with methylprednisolone. In some embodiments, the glucocorticoid treatment is treatment with dexamethasone. In some embodiments, the glucocorticoid treatment is treatment with betamethasone. In some embodiments, the glucocorticoid treatment is treatment with triamcinolone. In some embodiments, the glucocorticoid treatment is treatment with beclomethasone. In some embodiments, the glucocorticoid treatment is treatment with fludrocortisone acetate. In some embodiments, the glucocorticoid treatment is treatment with DOCA. In some embodiments, the glucocorticoid treatment is treatment with aldosterone. In some embodiments, the glucocorticoid treatment is treatment with budesonide. In some embodiments, the glucocorticoid treatment is treatment with mometasone furoate. In some embodiments, the glucocorticoid treatment is treatment with fluticasone propionate. In some embodiments, the glucocorticoid treatment is treatment with hydrocortisone. In some embodiments, the glucocorticoid treatment is treatment with cortisone acetate. In some embodiments, the glucocorticoid treatment is treatment with fluticasone furoate. In some embodiments, the glucocorticoid treatment is treatment with difluprednate ophthalmic. In some embodiments, the glucocorticoid treatment is treatment with fluorometholone. In some embodiments, the glucocorticoid treatment is treatment with loteprednol etabonate. In some embodiments, the glucocorticoid treatment is treatment with medrysone. In some embodiments, the glucocorticoid treatment is treatment with rimexolone. In some embodiments, the glucocorticoid treatment is treatment with fluocinolone acetonide. In some embodiments, the glucocorticoid treatment is treatment with clobetasol. In some embodiments, the glucocorticoid treatment is treatment with halobetasol. In some embodiments, the glucocorticoid treatment is treatment with diflorasone. In some embodiments, the glucocorticoid treatment is treatment with fluocinonide. In some embodiments, the glucocorticoid treatment is treatment with flurandrenolide. In some embodiments, the glucocorticoid treatment is treatment with Neo-Poly-Dex. In some embodiments, the glucocorticoid treatment is treatment with tobramycin-dexamethasone. In some embodiments, the glucocorticoid treatment is treatment with difluprednate.

Determining whether a subject has an ANGPTL7 predicted loss-of-function variant nucleic acid molecule in a biological sample from the subject and/or determining whether a subject has an ANGPTL7 predicted loss-of-function variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when a subject is identified as having an increased risk of developing a glucocorticoid-induced ophthalmic condition, the subject is further treated with an ANGPTL7 inhibitor, as described herein. For example, when the subject is ANGPTL7 reference, and therefore has an increased risk for developing a glucocorticoid-induced ophthalmic condition, the subject is administered an ANGPTL7 inhibitor. In some embodiments, when the subject is heterozygous for an ANGPTL7 predicted loss-of-function variant nucleic acid molecule, the subject is administered an ANGPTL7 inhibitor. In some embodiments, the subject is ANGPTL7 reference. In some embodiments, the subject is heterozygous for an ANGPTL7 predicted loss-of-function variant.

The present disclosure also provides methods of detecting the presence or absence of an ANGPTL7 predicted loss-of-function variant genomic nucleic acid molecule in a biological sample from a subject, and/or an ANGPTL7 predicted loss-of-function variant mRNA molecule in a biological sample from a subject, and/or an ANGPTL7 predicted loss-of-function variant cDNA molecule produced from an mRNA molecule in a biological sample from a subject. It is understood that gene sequences within a population and mRNA molecules encoded by such genes can vary due to polymorphisms such as single-nucleotide polymorphisms. The sequences provided herein for the ANGPTL7 variant genomic nucleic acid molecule, ANGPTL7 variant mRNA molecule, and ANGPTL7 variant cDNA molecule are only exemplary sequences. Other sequences for the ANGPTL7 variant genomic nucleic acid molecule, variant mRNA molecule, and variant cDNA molecule are also possible.

The biological sample can be derived from any cell, tissue, or biological fluid from the subject. The biological sample may comprise any clinically relevant tissue such as, for example, a bone marrow sample, a tumor biopsy, a fine needle aspirate, or a sample of bodily fluid, such as blood, gingival crevicular fluid, plasma, serum, lymph, ascitic fluid, cystic fluid, or urine. In some embodiments, the sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any ANGPTL7 variant nucleic acid molecule, preliminary processing designed to isolate or enrich the biological sample for the ANGPTL7 variant nucleic acid molecule can be employed. A variety of techniques may be used for this purpose. When detecting the level of any ANGPTL7 variant mRNA molecule, different techniques can be used enrich the biological sample with mRNA molecules. Various methods to detect the presence or level of an mRNA molecule or the presence of a particular variant genomic DNA locus can be used.

In some embodiments, detecting an ANGPTL7 predicted loss-of-function variant nucleic acid molecule in a subject comprises assaying or analyzing a biological sample obtained from the subject to determine whether an ANGPTL7 genomic nucleic acid molecule in the biological sample, an ANGPTL7 mRNA molecule in the biological sample, and/or an ANGPTL7 cDNA molecule produced from an mRNA molecule in the biological sample, comprises one or more variations that cause a loss-of-function (partial or complete) or are predicted to cause a loss-of-function (partial or complete).

In some embodiments, the methods of detecting the presence or absence of an ANGPTL7 predicted loss-of-function variant nucleic acid molecule (such as, for example, a genomic nucleic acid molecule, an mRNA molecule, and/or a cDNA molecule produced from an mRNA molecule) in a subject, comprise performing an assay on a biological sample obtained from the subject. The assay determines whether a nucleic acid molecule in the biological sample comprises a particular nucleotide sequence.

In some embodiments, the nucleotide sequence comprises: a thymine at a position corresponding to position 4,291 according to SEQ ID NO:2 (for genomic nucleic acid molecules); a uracil at a position corresponding to position 529 according to SEQ ID NO:8 (for mRNA molecules); or a thymine at a position corresponding to position 529 according to SEQ ID NO:14 (for cDNA molecules obtained from mRNA molecules).

In some embodiments, the nucleotide sequence comprises: a thymine at a position corresponding to position 4,287 according to SEQ ID NO:3 (for genomic nucleic acid molecules); a uracil at a position corresponding to position 525 according to SEQ ID NO:9 (for mRNA molecules); or a thymine at a position corresponding to position 525 according to SEQ ID NO:15 (for cDNA molecules obtained from mRNA molecules).

In some embodiments, the nucleotide sequence comprises: an adenine at a position corresponding to position 4,243 according to SEQ ID NO:4 (for genomic nucleic acid molecules); an adenine at a position corresponding to position 481 according to SEQ ID NO:10 (for mRNA molecules); or an adenine at a position corresponding to position 481 according to SEQ ID NO:16 (for cDNA molecules obtained from mRNA molecules).

In some embodiments, the nucleotide sequence comprises: an adenine at a position corresponding to position 4,325 according to SEQ ID NO:5 (for genomic nucleic acid molecules); an adenine at a position corresponding to position 563 according to SEQ ID NO:11 (for mRNA molecules); or an adenine at a position corresponding to position 563 according to SEQ ID NO:17 (for cDNA molecules obtained from mRNA molecules).

In some embodiments, the nucleotide sequence comprises: a cytosine at a position corresponding to position 4,336 according to SEQ ID NO:6 (for genomic nucleic acid molecules); a cytosine at a position corresponding to position 574 according to SEQ ID NO:12 (for mRNA molecules); or a cytosine at a position corresponding to position 574 according to SEQ ID NO:18 (for cDNA molecules obtained from mRNA molecules).

In some embodiments, the nucleotide sequence comprises: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof.

In some embodiments, the nucleotide sequence comprises: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof.

In some embodiments, the nucleotide sequence comprises: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof.

In some embodiments, the biological sample comprises a cell or cell lysate. Such methods can further comprise, for example, obtaining a biological sample from the subject comprising an ANGPTL7 genomic nucleic acid molecule or mRNA molecule, and if mRNA, optionally reverse transcribing the mRNA into cDNA. Such assays can comprise, for example determining the identity of these positions of the particular ANGPTL7 nucleic acid molecule. In some embodiments, the method is an in vitro method.

In some embodiments, the determining step, detecting step, or sequence analysis comprises sequencing at least a portion of the nucleotide sequence of the ANGPTL7 genomic nucleic acid molecule, the ANGPTL7 mRNA molecule, or the ANGPTL7 cDNA molecule produced from the mRNA molecule in the biological sample, wherein the sequenced portion comprises one or more variations that cause a loss-of-function (partial or complete) or are predicted to cause a loss-of-function (partial or complete).

In some embodiments, the determining step, detecting step, or sequence analysis comprises sequencing at least a portion of: the nucleotide sequence of the ANGPTL7 genomic nucleic acid molecule in the biological sample, wherein the sequenced portion comprises a position corresponding to position 4,291 according to SEQ ID NO:2, or the complement thereof; the nucleotide sequence of the ANGPTL7 mRNA molecule in the biological sample, wherein the sequenced portion comprises a position corresponding to position 529 according to SEQ ID NO:8, or the complement thereof; and/or the nucleotide sequence of the ANGPTL7 cDNA molecule produced from the mRNA in the biological sample, wherein the sequenced portion comprises a position corresponding to position 529 according to SEQ ID NO:14, or the complement thereof. When the sequenced portion of the ANGPTL7 nucleic acid molecule in the biological sample comprises: a thymine at a position corresponding to position 4,291 according to SEQ ID NO:2, a uracil at a position corresponding to position 529 according to SEQ ID NO:8, or a thymine at a position corresponding to position 529 according to SEQ ID NO:14, then the ANGPTL7 nucleic acid molecule in the biological sample is an ANGPTL7 predicted loss-of-function variant nucleic acid molecule.

In some embodiments, the determining step, detecting step, or sequence analysis comprises sequencing at least a portion of: the nucleotide sequence of the ANGPTL7 genomic nucleic acid molecule in the biological sample, wherein the sequenced portion comprises a position corresponding to position 4,287 according to SEQ ID NO:3, or the complement thereof; the nucleotide sequence of the ANGPTL7 mRNA molecule in the biological sample, wherein the sequenced portion comprises a position corresponding to position 525 according to SEQ ID NO:9, or the complement thereof; and/or the nucleotide sequence of the ANGPTL7 cDNA molecule produced from the mRNA in the biological sample, wherein the sequenced portion comprises a position corresponding to position 525 according to SEQ ID NO:15, or the complement thereof. When the sequenced portion of the ANGPTL7 nucleic acid molecule in the biological sample comprises: a thymine at a position corresponding to position 4,287 according to SEQ ID NO:3, a uracil at a position corresponding to position 525 according to SEQ ID NO:9, or a thymine at a position corresponding to position 525 according to SEQ ID NO:15, then the ANGPTL7 nucleic acid molecule in the biological sample is an ANGPTL7 predicted loss-of-function variant nucleic acid molecule.

In some embodiments, the determining step, detecting step, or sequence analysis comprises sequencing at least a portion of: the nucleotide sequence of the ANGPTL7 genomic nucleic acid molecule in the biological sample, wherein the sequenced portion comprises a position corresponding to position 4,243 according to SEQ ID NO:4, or the complement thereof; the nucleotide sequence of the ANGPTL7 mRNA molecule in the biological sample, wherein the sequenced portion comprises a position corresponding to position 481 according to SEQ ID NO:10, or the complement thereof; and/or the nucleotide sequence of the ANGPTL7 cDNA molecule produced from the mRNA in the biological sample, wherein the sequenced portion comprises a position corresponding to position 481 according to SEQ ID NO:16, or the complement thereof. When the sequenced portion of the ANGPTL7 nucleic acid molecule in the biological sample comprises: an adenine at a position corresponding to position 4,243 according to SEQ ID NO:4, an adenine at a position corresponding to position 481 according to SEQ ID NO:10, or an adenine at a position corresponding to position 481 according to SEQ ID NO:16, then the ANGPTL7 nucleic acid molecule in the biological sample is an ANGPTL7 predicted loss-of-function variant nucleic acid molecule.

In some embodiments, the determining step, detecting step, or sequence analysis comprises sequencing at least a portion of: the nucleotide sequence of the ANGPTL7 genomic nucleic acid molecule in the biological sample, wherein the sequenced portion comprises a position corresponding to position 4,325 according to SEQ ID NO:5, or the complement thereof; the nucleotide sequence of the ANGPTL7 mRNA molecule in the biological sample, wherein the sequenced portion comprises a position corresponding to position 563 according to SEQ ID NO:11, or the complement thereof; and/or the nucleotide sequence of the ANGPTL7 cDNA molecule produced from the mRNA in the biological sample, wherein the sequenced portion comprises a position corresponding to position 563 according to SEQ ID NO:17, or the complement thereof. When the sequenced portion of the ANGPTL7 nucleic acid molecule in the biological sample comprises: an adenine at a position corresponding to position 4,325 according to SEQ ID NO:5, an adenine at a position corresponding to position 563 according to SEQ ID NO:11, or an adenine at a position corresponding to position 563 according to SEQ ID NO:17, then the ANGPTL7 nucleic acid molecule in the biological sample is an ANGPTL7 predicted loss-of-function variant nucleic acid molecule.

In some embodiments, the determining step, detecting step, or sequence analysis comprises sequencing at least a portion of: the nucleotide sequence of the ANGPTL7 genomic nucleic acid molecule in the biological sample, wherein the sequenced portion comprises a position corresponding to position 4,336 according to SEQ ID NO:6, or the complement thereof; the nucleotide sequence of the ANGPTL7 mRNA molecule in the biological sample, wherein the sequenced portion comprises a position corresponding to position 574 according to SEQ ID NO:12, or the complement thereof; and/or the nucleotide sequence of the ANGPTL7 cDNA molecule produced from the mRNA in the biological sample, wherein the sequenced portion comprises a position corresponding to position 574 according to SEQ ID NO:18, or the complement thereof. When the sequenced portion of the ANGPTL7 nucleic acid molecule in the biological sample comprises: a cytosine at a position corresponding to position 4,336 according to SEQ ID NO:6, a cytosine at a position corresponding to position 574 according to SEQ ID NO:12, or a cytosine at a position corresponding to position 574 according to SEQ ID NO:18, then the ANGPTL7 nucleic acid molecule in the biological sample is an ANGPTL7 predicted loss-of-function variant nucleic acid molecule.

In some embodiments, the determining step, detecting step, or sequence analysis comprises sequencing at least a portion of the nucleotide sequence of the ANGPTL7 genomic nucleic acid molecule in the biological sample, wherein the sequenced portion comprises a position corresponding to: position 4,291 according to SEQ ID NO:2, or the complement thereof; position 4,287 according to SEQ ID NO:3, or the complement thereof; position 4,243 according to SEQ ID NO:4, or the complement thereof; position 4,325 according to SEQ ID NO:5, or the complement thereof; or position 4,336 according to SEQ ID NO:6, or the complement thereof. When the sequenced portion of the ANGPTL7 nucleic acid molecule in the biological sample comprises: i) a thymine at a position corresponding to position 4,291 according to SEQ ID NO:2, a thymine at a position corresponding to position 4,287 according to SEQ ID NO:3, an adenine at a position corresponding to position 4,243 according to SEQ ID NO:4, an adenine at a position corresponding to position 4,325 according to SEQ ID NO:5, or a cytosine at a position corresponding to position 4,336 according to SEQ ID NO:6, then the ANGPTL7 nucleic acid molecule in the biological sample is an ANGPTL7 predicted loss-of-function variant nucleic acid molecule.

In some embodiments, the determining step, detecting step, or sequence analysis comprises sequencing at least a portion of the nucleotide sequence of the ANGPTL7 mRNA molecule in the biological sample, wherein the sequenced portion comprises a position corresponding to: position 529 according to SEQ ID NO:8, or the complement thereof; position 525 according to SEQ ID NO:9, or the complement thereof; position 481 according to SEQ ID NO:10, or the complement thereof; position 563 according to SEQ ID NO:11, or the complement thereof; or position 574 according to SEQ ID NO:12, or the complement thereof. When the sequenced portion of the ANGPTL7 nucleic acid molecule in the biological sample comprises: a uracil at a position corresponding to position 529 according to SEQ ID NO:8, a uracil at a position corresponding to position 525 according to SEQ ID NO:9, an adenine at a position corresponding to position 481 according to SEQ ID NO:10, an adenine at a position corresponding to position 563 according to SEQ ID NO:11, or a cytosine at a position corresponding to position 574 according to SEQ ID NO:12, then the ANGPTL7 nucleic acid molecule in the biological sample is an ANGPTL7 predicted loss-of-function variant nucleic acid molecule.

In some embodiments, the determining step, detecting step, or sequence analysis comprises sequencing at least a portion of the nucleotide sequence of the ANGPTL7 cDNA molecule produced from the mRNA molecule in the biological sample, wherein the sequenced portion comprises a position corresponding to: position 529 according to SEQ ID NO:14, or the complement thereof; position 525 according to SEQ ID NO:15, or the complement thereof; position 481 according to SEQ ID NO:16, or the complement thereof; position 563 according to SEQ ID NO:17, or the complement thereof; or position 574 according to SEQ ID NO:18, or the complement thereof. When the sequenced portion of the ANGPTL7 nucleic acid molecule in the biological sample comprises: a thymine at a position corresponding to position 529 according to SEQ ID NO:14, a thymine at a position corresponding to position 525 according to SEQ ID NO:15, an adenine at a position corresponding to position 481 according to SEQ ID NO:16, an adenine at a position corresponding to position 563 according to SEQ ID NO:17, or a cytosine at a position corresponding to position 574 according to SEQ ID NO:18, then the ANGPTL7 nucleic acid molecule in the biological sample is an ANGPTL7 predicted loss-of-function variant nucleic acid molecule.

In some embodiments, the determining step, detecting step, or sequence analysis comprises: a) contacting the biological sample with a primer hybridizing to a portion of the nucleotide sequence of the ANGPTL7: genomic nucleic acid molecule that is proximate to a position corresponding to position 4,291 according to SEQ ID NO:2; mRNA molecule that is proximate to a position corresponding to position 529 according to SEQ ID NO:8; and/or cDNA molecule that is proximate to a position corresponding to position 529 according to SEQ ID NO:14; b) extending the primer at least through the position of the nucleotide sequence of the ANGPTL7: genomic nucleic acid molecule corresponding to position 4,291 according to SEQ ID NO:2; mRNA molecule corresponding to position 529 according to SEQ ID NO:8; and/or cDNA molecule corresponding to position 529 according to SEQ ID NO:14; and c) determining whether the extension product of the primer comprises: a thymine at a position corresponding to position 4,291 according to SEQ ID NO:2, a uracil at a position corresponding to position 529 according to SEQ ID NO:8, and/or a thymine at a position corresponding to position 529 according to SEQ ID NO:14.

In some embodiments, the determining step, detecting step, or sequence analysis comprises: a) contacting the biological sample with a primer hybridizing to a portion of the nucleotide sequence of the ANGPTL7: genomic nucleic acid molecule that is proximate to a position corresponding to position 4,287 according to SEQ ID NO:3; mRNA molecule that is proximate to a position corresponding to position 525 according to SEQ ID NO:9; and/or cDNA molecule that is proximate to a position corresponding to position 525 according to SEQ ID NO:15; b) extending the primer at least through the position of the nucleotide sequence of the ANGPTL7: genomic nucleic acid molecule corresponding to position 4,287 according to SEQ ID NO:3; mRNA molecule corresponding to position 525 according to SEQ ID NO:9; and/or cDNA molecule corresponding to position 525 according to SEQ ID NO:15; and c) determining whether the extension product of the primer comprises: a thymine at a position corresponding to position 4,287 according to SEQ ID NO:3, a uracil at a position corresponding to position 525 according to SEQ ID NO:9, and/or a thymine at a position corresponding to position 525 according to SEQ ID NO:15.

In some embodiments, the determining step, detecting step, or sequence analysis comprises: a) contacting the biological sample with a primer hybridizing to a portion of the nucleotide sequence of the ANGPTL7: genomic nucleic acid molecule that is proximate to a position corresponding to position 4,243 according to SEQ ID NO:4; mRNA molecule that is proximate to a position corresponding to position 481 according to SEQ ID NO:10; and/or cDNA molecule that is proximate to a position corresponding to position 481 according to SEQ ID NO:16; b) extending the primer at least through the position of the nucleotide sequence of the ANGPTL7: genomic nucleic acid molecule corresponding to position 4,243 according to SEQ ID NO:4; mRNA molecule corresponding to position 481 according to SEQ ID NO:10; and/or cDNA molecule corresponding to position 481 according to SEQ ID NO:16; and c) determining whether the extension product of the primer comprises: an adenine at a position corresponding to position 4,243 according to SEQ ID NO:4, an adenine at a position corresponding to position 481 according to SEQ ID NO:10, and/or an adenine at a position corresponding to position 481 according to SEQ ID NO:16.

In some embodiments, the determining step, detecting step, or sequence analysis comprises: a) contacting the biological sample with a primer hybridizing to a portion of the nucleotide sequence of the ANGPTL7: genomic nucleic acid molecule that is proximate to a position corresponding to position 4,325 according to SEQ ID NO:5; mRNA molecule that is proximate to a position corresponding to position 563 according to SEQ ID NO:11; and/or cDNA molecule that is proximate to a position corresponding to position 563 according to SEQ ID NO:17; b) extending the primer at least through the position of the nucleotide sequence of the ANGPTL7: genomic nucleic acid molecule corresponding to position 4,325 according to SEQ ID NO:5; mRNA molecule corresponding to position 563 according to SEQ ID NO:11; and/or cDNA molecule corresponding to position 563 according to SEQ ID NO:17; and c) determining whether the extension product of the primer comprises: an adenine at a position corresponding to position 4,325 according to SEQ ID NO:5, an adenine at a position corresponding to position 563 according to SEQ ID NO:11, and/or an adenine at a position corresponding to position 563 according to SEQ ID NO:17.

In some embodiments, the determining step, detecting step, or sequence analysis comprises: a) contacting the biological sample with a primer hybridizing to a portion of the nucleotide sequence of the ANGPTL7: genomic nucleic acid molecule that is proximate to a position corresponding to position 4,336 according to SEQ ID NO:6; mRNA molecule that is proximate to a position corresponding to position 574 according to SEQ ID NO:12; and/or cDNA molecule that is proximate to a position corresponding to position 574 according to SEQ ID NO:18; b) extending the primer at least through the position of the nucleotide sequence of the ANGPTL7: genomic nucleic acid molecule corresponding to position 4,336 according to SEQ ID NO:6; mRNA molecule corresponding to position 574 according to SEQ ID NO:12; and/or cDNA molecule corresponding to position 574 according to SEQ ID NO:18; and c) determining whether the extension product of the primer comprises: a cytosine at a position corresponding to position 4,336 according to SEQ ID NO:6, a cytosine at a position corresponding to position 574 according to SEQ ID NO:12, and/or a cytosine at a position corresponding to position 574 according to SEQ ID NO:18.

In some embodiments, the determining step, detecting step, or sequence analysis comprises: a) contacting the biological sample with a primer hybridizing to a portion of the nucleotide sequence of the ANGPTL7 genomic nucleic acid molecule that is proximate to a position corresponding to: position 4,291 according to SEQ ID NO:2, position 4,287 according to SEQ ID NO:3, position 4,243 according to SEQ ID NO:4, position 4,325 according to SEQ ID NO:5, or position 4,336 according to SEQ ID NO:6; b) extending the primer at least through the position of the nucleotide sequence of the ANGPTL7 genomic nucleic acid molecule corresponding to: position 4,291 according to SEQ ID NO:2, position 4,287 according to SEQ ID NO:3, position 4,243 according to SEQ ID NO:4, position 4,325 according to SEQ ID NO:5, or position 4,336 according to SEQ ID NO:6; and c) determining whether the extension product of the primer comprises: a thymine at a position corresponding to position 4,291 according to SEQ ID NO:2, a thymine at a position corresponding to position 4,287 according to SEQ ID NO:3, an adenine at a position corresponding to position 4,243 according to SEQ ID NO:4, an adenine at a position corresponding to position 4,325 according to SEQ ID NO:5, or a cytosine at a position corresponding to position 4,336 according to SEQ ID NO:6.

In some embodiments, the determining step, detecting step, or sequence analysis comprises: a) contacting the biological sample with a primer hybridizing to a portion of the nucleotide sequence of the ANGPTL7 mRNA molecule that is proximate to a position corresponding to: position 529 according to SEQ ID NO:8, position 525 according to SEQ ID NO:9, position 481 according to SEQ ID NO:10; position 563 according to SEQ ID NO:11, or position 574 according to SEQ ID NO:12; b) extending the primer at least through the position of the nucleotide sequence of the ANGPTL7 mRNA molecule corresponding to: position 529 according to SEQ ID NO:8, position 525 according to SEQ ID NO:9, position 481 according to SEQ ID NO:10, position 563 according to SEQ ID NO:11, or position 574 according to SEQ ID NO:12; and c) determining whether the extension product of the primer comprises: a uracil at a position corresponding to position 529 according to SEQ ID NO:8, a uracil at a position corresponding to position 525 according to SEQ ID NO:9, an adenine at a position corresponding to position 481 according to SEQ ID NO:10, an adenine at a position corresponding to position 563 according to SEQ ID NO:11, or a cytosine at a position corresponding to position 574 according to SEQ ID NO:12.

In some embodiments, the determining step, detecting step, or sequence analysis comprises: a) contacting the biological sample with a primer hybridizing to a portion of the nucleotide sequence of the ANGPTL7 cDNA molecule that is proximate to a position corresponding to: position 529 according to SEQ ID NO:14, position 525 according to SEQ ID NO:15, position 481 according to SEQ ID NO:16, position 563 according to SEQ ID NO:17, or position 574 according to SEQ ID NO:18; b) extending the primer at least through the position of the nucleotide sequence of the ANGPTL7 cDNA molecule corresponding to: position 529 according to SEQ ID NO:14, position 525 according to SEQ ID NO:15, position 481 according to SEQ ID NO:16, position 563 according to SEQ ID NO:17, or position 574 according to SEQ ID NO:18, and c) determining whether the extension product of the primer comprises: a thymine at a position corresponding to position 529 according to SEQ ID NO:14, a thymine at a position corresponding to position 525 according to SEQ ID NO:15, an adenine at a position corresponding to position 481 according to SEQ ID NO:16, an adenine at a position corresponding to position 563 according to SEQ ID NO:17, or a cytosine at a position corresponding to position 574 according to SEQ ID NO:18.

In some embodiments, the assay comprises sequencing the entire nucleic acid molecule. In some embodiments, only an ANGPTL7 genomic nucleic acid molecule is analyzed. In some embodiments, only an ANGPTL7 mRNA is analyzed. In some embodiments, only an ANGPTL7 cDNA obtained from ANGPTL7 mRNA is analyzed.

In some embodiments, the determining step, detecting step, or sequence analysis comprises: a) amplifying at least a portion of the nucleic acid molecule that encodes the ANGPTL7 polypeptide, wherein the amplified portion comprises: a thymine at a position corresponding to position 4,291 according to SEQ ID NO:2, or the complement thereof; a uracil at a position corresponding to position 529 according to SEQ ID NO:8, or the complement thereof; and/or a thymine at a position corresponding to position 529 according to SEQ ID NO:14, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a thymine at a position corresponding to position 4,291 according to SEQ ID NO:2, or the complement thereof; a uracil at a position corresponding to position 529 according to SEQ ID NO:8, or the complement thereof; and/or a thymine at a position corresponding to position 529 according to SEQ ID NO:14, or the complement thereof; and d) detecting the detectable label.

In some embodiments, the determining step, detecting step, or sequence analysis comprises: a) amplifying at least a portion of the nucleic acid molecule that encodes the ANGPTL7 polypeptide, wherein the amplified portion comprises: a thymine at a position corresponding to position 4,287 according to SEQ ID NO:3, or the complement thereof; a uracil at a position corresponding to position 525 according to SEQ ID NO:9, or the complement thereof; and/or a thymine at a position corresponding to position 525 according to SEQ ID NO:15, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a thymine at a position corresponding to position 4,287 according to SEQ ID NO:3, or the complement thereof; a uracil at a position corresponding to position 525 according to SEQ ID NO:9, or the complement thereof; and/or a thymine at a position corresponding to position 525 according to SEQ ID NO:15, or the complement thereof; and d) detecting the detectable label.

In some embodiments, the determining step, detecting step, or sequence analysis comprises: a) amplifying at least a portion of the nucleic acid molecule that encodes the ANGPTL7 polypeptide, wherein the amplified portion comprises: an adenine at a position corresponding to position 4,243 according to SEQ ID NO:4, or the complement thereof; an adenine at a position corresponding to position 481 according to SEQ ID NO:10, or the complement thereof; and/or an adenine at a position corresponding to position 481 according to SEQ ID NO:16, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: an adenine at a position corresponding to position 4,243 according to SEQ ID NO:4, or the complement thereof; an adenine at a position corresponding to position 481 according to SEQ ID NO:10, or the complement thereof; and/or an adenine at a position corresponding to position 481 according to SEQ ID NO:16, or the complement thereof; and d) detecting the detectable label.

In some embodiments, the determining step, detecting step, or sequence analysis comprises: a) amplifying at least a portion of the nucleic acid molecule that encodes the ANGPTL7 polypeptide, wherein the amplified portion comprises: an adenine at a position corresponding to position 4,325 according to SEQ ID NO:5, or the complement thereof; an adenine at a position corresponding to position 563 according to SEQ ID NO:11, or the complement thereof; and/or an adenine at a position corresponding to position 563 according to SEQ ID NO:17, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: an adenine at a position corresponding to position 4,325 according to SEQ ID NO:5, or the complement thereof; an adenine at a position corresponding to position 563 according to SEQ ID NO:11, or the complement thereof; and/or an adenine at a position corresponding to position 563 according to SEQ ID NO:17, or the complement thereof; and d) detecting the detectable label.

In some embodiments, the determining step, detecting step, or sequence analysis comprises: a) amplifying at least a portion of the nucleic acid molecule that encodes the ANGPTL7 polypeptide, wherein the amplified portion comprises: a cytosine at a position corresponding to position 4,336 according to SEQ ID NO:6, or the complement thereof; a cytosine at a position corresponding to position 574 according to SEQ ID NO:12, or the complement thereof; and/or a cytosine at a position corresponding to position 574 according to SEQ ID NO:18, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a cytosine at a position corresponding to position 4,336 according to SEQ ID NO:6, or the complement thereof; a cytosine at a position corresponding to position 574 according to SEQ ID NO:12, or the complement thereof; and/or a cytosine at a position corresponding to position 574 according to SEQ ID NO:18, or the complement thereof; and d) detecting the detectable label.

In some embodiments, the determining step, detecting step, or sequence analysis comprises: a) amplifying at least a portion of the nucleic acid molecule that encodes the ANGPTL7 polypeptide, wherein the amplified portion comprises: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof; and d) detecting the detectable label.

In some embodiments, the determining step, detecting step, or sequence analysis comprises: a) amplifying at least a portion of the nucleic acid molecule that encodes the ANGPTL7 polypeptide, wherein the amplified portion comprises: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof; and d) detecting the detectable label.

In some embodiments, the determining step, detecting step, or sequence analysis comprises: a) amplifying at least a portion of the nucleic acid molecule that encodes the ANGPTL7 polypeptide, wherein the amplified portion comprises: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof; and d) detecting the detectable label.

In some embodiments, the nucleic acid molecule is mRNA and the determining step further comprises reverse-transcribing the mRNA into a cDNA prior to the amplifying step.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a thymine at a position corresponding to position 4,291 according to SEQ ID NO:2, or the complement thereof; a uracil at a position corresponding to position 529 according to SEQ ID NO:8, or the complement thereof; and/or a thymine at a position corresponding to position 529 according to SEQ ID NO:14, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a thymine at a position corresponding to position 4,287 according to SEQ ID NO:3, or the complement thereof; a uracil at a position corresponding to position 525 according to SEQ ID NO:9, or the complement thereof; and/or a thymine at a position corresponding to position 525 according to SEQ ID NO:15, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: an adenine at a position corresponding to position 4,243 according to SEQ ID NO:4, or the complement thereof; an adenine at a position corresponding to position 481 according to SEQ ID NO:10, or the complement thereof; and/or an adenine at a position corresponding to position 481 according to SEQ ID NO:16, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: an adenine at a position corresponding to position 4,325 according to SEQ ID NO:5, or the complement thereof; an adenine at a position corresponding to position 563 according to SEQ ID NO:11, or the complement thereof; and/or an adenine at a position corresponding to position 563 according to SEQ ID NO:17, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a cytosine at a position corresponding to position 4,336 according to SEQ ID NO:6, or the complement thereof; a cytosine at a position corresponding to position 574 according to SEQ ID NO:12, or the complement thereof; and/or a cytosine at a position corresponding to position 574 according to SEQ ID NO:18, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof; and detecting the detectable label.

Alteration-specific polymerase chain reaction techniques can be used to detect mutations such as SNPs in a nucleic acid sequence. Alteration-specific primers can be used because the DNA polymerase will not extend when a mismatch with the template is present.

In some embodiments, the nucleic acid molecule in the sample is mRNA and the mRNA is reverse-transcribed into a cDNA prior to the amplifying step. In some embodiments, the nucleic acid molecule is present within a cell obtained from the subject.

In some embodiments, the assay comprises contacting the biological sample with a primer or probe, such as an alteration-specific primer or alteration-specific probe, that specifically hybridizes to an ANGPTL7 variant genomic sequence, variant mRNA sequence, or variant cDNA sequence and not the corresponding ANGPTL7 reference sequence under stringent conditions, and determining whether hybridization has occurred.

In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising an ANGPTL7 variant genomic nucleic acid molecule, variant mRNA molecule, or variant cDNA molecule. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

In some embodiments, to determine whether an ANGPTL7 nucleic acid molecule (genomic nucleic acid molecule, mRNA molecule, or cDNA molecule), or complement thereof, within a biological sample comprises a nucleotide sequence comprising a thymine at a position corresponding to position 4,291 according to SEQ ID NO:2 (genomic nucleic acid molecule), a uracil at a position corresponding to position 529 according to SEQ ID NO:8 (mRNA molecule), or a thymine at a position corresponding to position 529 according to SEQ ID NO:14 (cDNA molecule), the biological sample can be subjected to an amplification method using a primer pair that includes a first primer derived from the 5' flanking sequence adjacent to a thymine at a position corresponding to position 4,291 according to SEQ ID NO:2, a uracil at a position corresponding to position 529 according to SEQ ID NO:8, or a thymine at a position corresponding to position 529 according to SEQ ID NO:14, and a second primer derived from the 3' flanking sequence adjacent to a thymine at a position corresponding to position 4,291 according to SEQ ID NO:2, a uracil at a position corresponding to position 529 according to SEQ ID NO:8, or a thymine at a position corresponding to position 529 according to SEQ ID NO:14 to produce an amplicon that is indicative of the presence of the SNP at positions encoding a thymine at a position corresponding to position 4,291 according to SEQ ID NO:2, a uracil at a position corresponding to position 529 according to SEQ ID NO:8, or a thymine at a position corresponding to position 529 according to SEQ ID NO:14. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a thymine at a position corresponding to position 4,291 according to SEQ ID NO:2, a uracil at a position corresponding to position 529 according to SEQ ID NO:8, or a thymine at a position corresponding to position 529 according to SEQ ID NO:14, and at least 1, 2, 3, 4, 5, 6, 7, 8, 9, 10, or more nucleotides on each side of positions comprising a thymine at a position corresponding to position 4,291 according to SEQ ID NO:2, a uracil at a position corresponding to position 529 according to SEQ ID NO:8, or a thymine at a position corresponding to position 529 according to SEQ ID NO:14.

In some embodiments, to determine whether an ANGPTL7 nucleic acid molecule (genomic nucleic acid molecule, mRNA molecule, or cDNA molecule), or complement thereof, within a biological sample comprises a nucleotide sequence comprising a thymine at a position corresponding to position 4,287 according to SEQ ID NO:3 (genomic nucleic acid molecule), a uracil at a position corresponding to position 525 according to SEQ ID NO:9 (mRNA molecule), or a thymine at a position corresponding to position 525 according to SEQ ID NO:15 (cDNA molecule), the biological sample can be subjected to an amplification method using a primer pair that includes a first primer derived from the 5' flanking sequence adjacent to a thymine at a position corresponding to position 4,287 according to SEQ ID NO:3, a uracil at a position corresponding to position 525 according to SEQ ID NO:9, or a thymine at a position corresponding to position 525 according to SEQ ID NO:15, and a second primer derived from the 3' flanking sequence adjacent to a thymine at a position corresponding to position 4,287 according to SEQ ID NO:3, a uracil at a position corresponding to position 525 according to SEQ ID NO:9, or a thymine at a position corresponding to position 525 according to SEQ ID NO:15 to produce an amplicon that is indicative of the presence of the SNP at positions encoding a thymine at a position corresponding to position 4,287 according to SEQ ID NO:3, a uracil at a position corresponding to position 525 according to SEQ ID NO:9, or a thymine at a position corresponding to position 525 according to SEQ ID NO:15. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a thymine at a position corresponding to position 4,287 according to SEQ ID NO:3, a uracil at a position corresponding to position 525 according to SEQ ID NO:9, or a thymine at a position corresponding to position 525 according to SEQ ID NO:15, and at least 1, 2, 3, 4, 5, 6, 7, 8, 9, 10, or more nucleotides on each side of positions comprising a thymine at a position corresponding to position 4,287 according to SEQ ID NO:3, a uracil at a position corresponding to position 525 according to SEQ ID NO:9, or a thymine at a position corresponding to position 525 according to SEQ ID NO:15.

In some embodiments, to determine whether an ANGPTL7 nucleic acid molecule (genomic nucleic acid molecule, mRNA molecule, or cDNA molecule), or complement thereof, within a biological sample comprises a nucleotide sequence comprising an adenine at a position corresponding to position 4,243 according to SEQ ID NO:4 (genomic nucleic acid molecule), an adenine at a position corresponding to position 481 according to SEQ ID NO:10 (mRNA molecule), or an adenine at a position corresponding to position 481 according to SEQ ID NO:16 (cDNA molecule), the biological sample can be subjected to an amplification method using a primer pair that includes a first primer derived from the 5' flanking sequence adjacent to an adenine at a position corresponding to position 4,243 according to SEQ ID NO:4, an adenine at a position corresponding to position 481 according to SEQ ID NO:10, or an adenine at a position corresponding to position 481 according to SEQ ID NO:16, and a second primer derived from the 3' flanking sequence adjacent to an adenine at a position corresponding to position 4,243 according to SEQ ID NO:4, an adenine at a position corresponding to position 481 according to SEQ ID NO:10, or an adenine at a position corresponding to position 481 according to SEQ ID NO:16 to produce an amplicon that is indicative of the presence of the SNP at positions encoding an adenine at a position corresponding to position 4,243 according to SEQ ID NO:4, an adenine at a position corresponding to position 481 according to SEQ ID NO:10, or an adenine at a position corresponding to position 481 according to SEQ ID NO:16. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising an adenine at a position corresponding to position 4,243 according to SEQ ID NO:4, an adenine at a position corresponding to position 481 according to SEQ ID NO:10, or an adenine at a position corresponding to position 481 according to SEQ ID NO:16, and at least 1, 2, 3, 4, 5, 6, 7, 8, 9, 10, or more nucleotides on each side of positions comprising an adenine at a position corresponding to position 4,243 according to SEQ ID NO:4, an adenine at a position corresponding to position 481 according to SEQ ID NO:10, or an adenine at a position corresponding to position 481 according to SEQ ID NO:16.

In some embodiments, to determine whether an ANGPTL7 nucleic acid molecule (genomic nucleic acid molecule, mRNA molecule, or cDNA molecule), or complement thereof, within a biological sample comprises a nucleotide sequence comprising an adenine at a position corresponding to position 4,325 according to SEQ ID NO:5 (genomic nucleic acid molecule), an adenine at a position corresponding to position 563 according to SEQ ID NO:11 (mRNA molecule), or an adenine at a position corresponding to position 563 according to SEQ ID NO:17 (cDNA molecule), the biological sample can be subjected to an amplification method using a primer pair that includes a first primer derived from the 5' flanking sequence adjacent to an adenine at a position corresponding to position 4,325 according to SEQ ID NO:5, an adenine at a position corresponding to position 563 according to SEQ ID NO:11, or an adenine at a position corresponding to position 563 according to SEQ ID NO:17, and a second primer derived from the 3' flanking sequence adjacent to an adenine at a position corresponding to position 4,325 according to SEQ ID NO:5, an adenine at a position corresponding to position 563 according to SEQ ID NO:11, or an adenine at a position corresponding to position 563 according to SEQ ID NO:17 to produce an amplicon that is indicative of the presence of the SNP at positions encoding an adenine at a position corresponding to position 4,325 according to SEQ ID NO:5, an adenine at a position corresponding to position 563 according to SEQ ID NO:11, or an adenine at a position corresponding to position 563 according to SEQ ID NO:17. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising an adenine at a position corresponding to position 4,325 according to SEQ ID NO:5, an adenine at a position corresponding to position 563 according to SEQ ID NO:11, or an adenine at a position corresponding to position 563 according to SEQ ID NO:17, and at least 1, 2, 3, 4, 5, 6, 7, 8, 9, 10, or more nucleotides on each side of positions comprising an adenine at a position corresponding to position 4,325 according to SEQ ID NO:5, an adenine at a position corresponding to position 563 according to SEQ ID NO:11, or an adenine at a position corresponding to position 563 according to SEQ ID NO:17.

In some embodiments, to determine whether an ANGPTL7 nucleic acid molecule (genomic nucleic acid molecule, mRNA molecule, or cDNA molecule), or complement thereof, within a biological sample comprises a nucleotide sequence comprising a cytosine at a position corresponding to position 4,336 according to SEQ ID NO:6 (genomic nucleic acid molecule), a cytosine at a position corresponding to position 574 according to SEQ ID NO:12 (mRNA molecule), or a cytosine at a position corresponding to position 574 according to SEQ ID NO:18 (cDNA molecule), the biological sample can be subjected to an amplification method using a primer pair that includes a first primer derived from the 5' flanking sequence adjacent to a cytosine at a position corresponding to position 4,336 according to SEQ ID NO:6, a cytosine at a position corresponding to position 574 according to SEQ ID NO:12, or a cytosine at a position corresponding to position 574 according to SEQ ID NO:18, and a second primer derived from the 3' flanking sequence adjacent to a cytosine at a position corresponding to position 4,336 according to SEQ ID NO:6, a cytosine at a position corresponding to position 574 according to SEQ ID NO:12, or a cytosine at a position corresponding to position 574 according to SEQ ID NO:18 to produce an amplicon that is indicative of the presence of the SNP at positions encoding a cytosine at a position corresponding to position 4,336 according to SEQ ID NO:6, a cytosine at a position corresponding to position 574 according to SEQ ID NO:12, or a cytosine at a position corresponding to position 574 according to SEQ ID NO:18. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a cytosine at a position corresponding to position 4,336 according to SEQ ID NO:6, a cytosine at a position corresponding to position 574 according to SEQ ID NO:12, or a cytosine at a position corresponding to position 574 according to SEQ ID NO:18, and at least 1, 2, 3, 4, 5, 6, 7, 8, 9, 10, or more nucleotides on each side of positions comprising a cytosine at a position corresponding to position 4,336 according to SEQ ID NO:6, a cytosine at a position corresponding to position 574 according to SEQ ID NO:12, or a cytosine at a position corresponding to position 574 according to SEQ ID NO:18.

Similar amplicons can be generated from the mRNA and/or cDNA sequences. PCR primer pairs can be derived from a known sequence, for example, by using computer programs intended for that purpose, such as the PCR primer analysis tool in Vector NTI version 10 (Informax Inc., Bethesda Md.); PrimerSelect (DNASTAR Inc., Madison, Wis.); and Primer3 (Version 0.4.0.COPYRGT., 1991, Whitehead Institute for Biomedical Research, Cambridge, Mass.). Additionally, the sequence can be visually scanned and primers manually identified using known guidelines.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneously with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. In some embodiments, a polynucleotide primer or probe under stringent conditions will hybridize to its target nucleotide sequence to a detectably greater degree than to other nucleotide sequences by at least 2-fold. In some embodiments, a polynucleotide primer or probe under stringent conditions will hybridize to its target nucleotide sequence to a detectably greater degree than to other nucleotide sequences by at least 3-fold. In some embodiments, a polynucleotide primer or probe under stringent conditions will hybridize to its target nucleotide sequence to a detectably greater degree than to other nucleotide sequences by at least 4-fold. In some embodiments, a polynucleotide primer or probe under stringent conditions will hybridize to its target nucleotide sequence to a detectably greater degree than to other nucleotide sequences by over 10-fold over background. Stringent conditions are sequence-dependent and will be different in different circumstances.

Appropriate stringency conditions which promote DNA hybridization, for example, 6× sodium chloride/sodium citrate (SSC) at about 45° C., followed by a wash of 2×SSC at 50° C., are known or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M $Na^+$ ion, typically about 0.01 to 1.0 M $Na^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The present disclosure also provides methods of detecting the presence of an ANGPTL7 predicted loss-of-function polypeptide comprising performing an assay on a biological sample obtained from the subject to determine whether an ANGPTL7 polypeptide in the subject contains one or more variations that causes the polypeptide to have a loss-of-function (partial or complete) or predicted loss-of-function (partial or complete). The ANGPTL7 predicted loss-of-function polypeptide can be any of the ANGPTL7 variant polypeptides described herein. In some embodiments, the methods detect the presence of ANGPTL7 Arg177STOP, Gln175His, Phe161Ile, Trp188STOP, Lys192Gln, Arg340His, Arg220His, Asn302Lys, or Arg220Cys. In some embodiments, the methods detect the presence of ANGPTL7 Arg177STOP, Gln175His, Phe161Ile, Trp188STOP, or Lys192Gln.

In some embodiments, the methods comprise performing an assay on a sample obtained from a subject to determine whether an ANGPTL7 polypeptide in the sample terminates at position 176 and does not comprise amino acids at positions corresponding to positions 177 to 346 according to SEQ ID NO:19. In some embodiments, the methods comprise performing an assay on a sample obtained from a subject to determine whether an ANGPTL7 polypeptide in the sample comprises a histidine at a position corresponding to position 175 according to SEQ ID NO:21. In some embodiments, the methods comprise performing an assay on a sample obtained from a subject to determine whether an ANGPTL7 polypeptide in the sample comprises an isoleucine at a position corresponding to position 161 according to SEQ ID NO:22. In some embodiments, the methods comprise performing an assay on a sample obtained from a subject to determine whether an ANGPTL7 polypeptide in the sample comprises terminates at position 187 and does not comprise amino acids at positions corresponding to positions 188 to 346 according to SEQ ID NO:19. In some embodiments, the methods comprise performing an assay on a sample obtained from a subject to determine whether an ANGPTL7 polypeptide in the sample comprises a glutamine at a position corresponding to position 192 according to SEQ ID NO:24.

In some embodiments, the determining step comprises sequencing at least a portion of the polypeptide that comprises a position corresponding to position 175 according to SEQ ID NO:21 or SEQ ID NO:19. In some embodiments, the determining step comprises sequencing at least a portion of the polypeptide that comprises a position corresponding to position 161 according to SEQ ID NO:22 or SEQ ID NO:19. In some embodiments, the determining step comprises sequencing at least a portion of the polypeptide that comprises a position corresponding to position 192 according to SEQ ID NO:24 or SEQ ID NO:19.

In some embodiments, the determining step comprises sequencing at least a portion of the ANGPTL7 polypeptide that may comprise positions corresponding to any positions that are C-terminal to position 176 according to SEQ ID NO:20. If amino acids are detected in the ANGPTL7 polypeptide at positions corresponding to positions 177 to 346 according to SEQ ID NO:19, then such ANGPTL7 polypeptide is an NGPTL7 reference polypeptide. An absence of positions 177 to 346 according to SEQ ID NO:19 in the ANGPTL7 polypeptide indicates that the ANGPTL7 polypeptide terminates at position 176 according to SEQ ID NO:20 and is an ANGPTL7 predicted loss-of-function polypeptide.

In some embodiments, the determining step comprises sequencing at least a portion of the ANGPTL7 polypeptide that may comprise positions corresponding to any positions that are C-terminal to position 187 according to SEQ ID NO:23. If amino acids are detected in the ANGPTL7 polypeptide at positions corresponding to positions 188 to 346 according to SEQ ID NO:19, then such ANGPTL7 polypeptide is an NGPTL7 reference polypeptide. An absence of positions 188 to 346 according to SEQ ID NO:19 in the ANGPTL7 polypeptide indicates that the ANGPTL7 polypeptide terminates at position 187 according to SEQ ID NO:23 and is an ANGPTL7 predicted loss-of-function polypeptide.

In some embodiments, the determining step comprises an immunoassay for detecting at least a portion of the polypeptide that comprises a position corresponding to position 175 according to SEQ ID NO:21 or SEQ ID NO:19. In some embodiments, the determining step comprises an immunoassay for detecting at least a portion of the polypeptide that comprises a position corresponding to position 161 according to SEQ ID NO:22 or SEQ ID NO:19. In some embodiments, the determining step comprises an immunoassay for detecting at least a portion of the polypeptide that comprises a position corresponding to position 192 according to SEQ ID NO:24 or SEQ ID NO:19.

In some embodiments, the determining step comprises an immunoassay for detecting at least a portion of the ANGPTL7 polypeptide that may comprise positions corresponding to any positions that are C-terminal to position 176 according to SEQ ID NO:20. If amino acids are detected in the ANGPTL7 polypeptide at positions corresponding to positions 177 to 346 according to SEQ ID NO:19, then such ANGPTL7 polypeptide is an NGPTL7 reference polypeptide. An absence of positions 177 to 346 according to SEQ ID NO:19 in the ANGPTL7 polypeptide indicates that the ANGPTL7 polypeptide terminates at position 176 according to SEQ ID NO:20 and is an ANGPTL7 predicted loss-of-function polypeptide.

In some embodiments, the determining step comprises an immunoassay for detecting at least a portion of the ANGPTL7 polypeptide that may comprise positions corresponding to any positions that are C-terminal to position 187 according to SEQ ID NO:23. If amino acids are detected in the ANGPTL7 polypeptide at positions corresponding to positions 188 to 346 according to SEQ ID NO:19, then such ANGPTL7 polypeptide is an NGPTL7 reference polypeptide. An absence of positions 188 to 346 according to SEQ ID NO:19 in the ANGPTL7 polypeptide indicates that the ANGPTL7 polypeptide terminates at position 187 according to SEQ ID NO:23 and is an ANGPTL7 predicted loss-of-function polypeptide.

In some embodiments, when the subject does not have an ANGPTL7 predicted loss-of-function polypeptide, the subject has an increased risk for developing a glucocorticoid-induced ophthalmic condition. In some embodiments, when the subject has an ANGPTL7 predicted loss-of-function polypeptide, the subject has a decreased risk for developing a glucocorticoid-induced ophthalmic condition.

The present disclosure also provides isolated nucleic acid molecules that hybridize to ANGPTL7 variant genomic nucleic acid molecules, ANGPTL7 variant mRNA molecules, and/or ANGPTL7 variant cDNA molecules (such as any of the genomic variant nucleic acid molecules, mRNA variant molecules, and cDNA variant molecules disclosed herein). In some embodiments, the isolated nucleic acid molecules hybridize to a portion of the ANGPTL7 nucleic acid molecule that includes a position corresponding to: position 4,291 according to SEQ ID NO:2, position 529 according to SEQ ID NO:8, or position 529 according to SEQ ID NO:14. In some embodiments, the isolated nucleic acid molecules hybridize to a portion of the ANGPTL7 nucleic acid molecule that includes a position corresponding to: position 4,287 according to SEQ ID NO:3, position 525 according to SEQ ID NO:9, or position 525 according to SEQ ID NO:15. In some embodiments, the isolated nucleic acid molecules hybridize to a portion of the ANGPTL7 nucleic acid molecule that includes a position corresponding: to position 4,243 according to SEQ ID NO:4, position 481 according to SEQ ID NO:10, or position 481 according to SEQ ID NO:16. In some embodiments, the isolated nucleic acid molecules hybridize to a portion of the ANGPTL7 nucleic acid molecule that includes a position corresponding to: position 4,325 according to SEQ ID NO:5, position 563 according to SEQ ID NO:11, or position 563 according to SEQ ID NO:17. In some embodiments, the isolated nucleic acid molecules hybridize to a portion of the ANGPTL7 nucleic acid molecule that includes a position corresponding to: position 4,336 according to SEQ ID NO:6, position 574 according to SEQ ID NO:12, or position 574 according to SEQ ID NO:18.

In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, or at least about 5000 nucleotides. In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides. In some embodiments, the isolated nucleic acid molecules comprise or consist of at least about 18 nucleotides. In some embodiments, the isolated nucleic acid molecules comprise or consists of at least about 15 nucleotides. In some embodiments, the isolated nucleic acid molecules consist of or comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides. In some embodiments, the isolated nucleic acid molecules consist of or comprise from about 18 to about 30 nucleotides. In some embodiments, the isolated nucleic acid molecules comprise or consist of at least about 15 nucleotides to at least about 35 nucleotides.

In some embodiments, such isolated nucleic acid molecules hybridize to ANGPTL7 variant nucleic acid molecules (such as genomic nucleic acid molecules, mRNA molecules, and/or cDNA molecules) under stringent conditions. Such nucleic acid molecules can be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein, and can be used in any of the methods described herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to ANGPTL7 variant genomic nucleic acid molecules, ANGPTL7 variant mRNA molecules, and/or ANGPTL7 variant cDNA molecules. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding an ANGPTL7 polypeptide, wherein the portion comprises a position corresponding to: position 4,291 according to SEQ ID NO:2, or the complement thereof; position 529 according to SEQ ID NO:8, or the complement thereof; or position 529 according to SEQ ID NO:14, or the complement thereof. In some embodiments, the alteration-specific probe or alteration-specific primer comprises a nucleotide sequence which is complementary to a portion of a nucleotide sequence comprising positions corresponding to: positions 4,291 to 4,293 according to SEQ ID NO:2, or the complement thereof; positions 529 to 531 according to SEQ ID NO:8, or the complement thereof; and/or positions 529 to 531 according to SEQ ID NO:14, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding an ANGPTL7 polypeptide, wherein the portion comprises a position corresponding to: position 4,287 according to SEQ ID NO:3, or the complement thereof; position 525 according to SEQ ID NO:9, or the complement thereof; or position 525 according to SEQ ID NO:15, or the complement thereof. In some embodiments, the alteration-specific probe or alteration-specific primer comprises a nucleotide sequence which is complementary to a portion of a nucleotide sequence comprising positions corresponding to: positions 4,285 to 4,287 according to SEQ ID NO:3, or the complement thereof; positions 523 to 525 according to SEQ ID NO:9, or the complement thereof; and/or positions 523 to 525 according to SEQ ID NO:15, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding an ANGPTL7 polypeptide, wherein the portion comprises a position corresponding to: position 4,243 according to SEQ ID NO:4, or the complement thereof; position 481 according to SEQ ID NO:10, or the complement thereof; or position 481 according to SEQ ID NO:16, or the complement thereof. In some embodiments, the alteration-specific probe or alteration-specific primer comprises a nucleotide sequence which is complementary to a portion of a nucleotide sequence comprising positions corresponding to: positions 4,243 to 4,245 according to SEQ ID NO:4, or the complement thereof; positions 481 to 483 according to SEQ ID NO:10, or the complement thereof; and/or positions 481 to 483 according to SEQ ID NO:16, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding an ANGPTL7 polypeptide, wherein the portion comprises a position corresponding to: position 4,325 according to SEQ ID NO:5, or the complement thereof; position 563 according to SEQ ID NO:11, or the complement thereof; or position 563 according to SEQ ID NO:17, or the complement thereof. In some embodiments, the alteration-specific probe or alteration-specific primer comprises a nucleotide sequence which is complementary to a portion of a nucleotide sequence comprising positions corresponding to: positions 4,324 to 4,326 according to SEQ ID NO:5, or the complement thereof; positions 562 to 564 according to SEQ ID NO:11, or the complement thereof; and/or positions 562 to 564 according to SEQ ID NO:17, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding an ANGPTL7 polypeptide, wherein the portion comprises a position corresponding to: position 4,336 according to SEQ ID NO:6, or the complement thereof; position 574 according to SEQ ID NO:12, or the complement thereof; or position 574 according to SEQ ID NO:18, or the complement thereof. In some embodiments, the alteration-specific probe or alteration-specific primer comprises a nucleotide sequence which is complementary to a portion of a nucleotide sequence comprising positions corresponding to: positions 4,336 to 4,338 according to SEQ ID NO:6, or the complement thereof; positions 574 to 576 according to SEQ ID NO:12, or the complement thereof; and/or positions 574 to 576 according to SEQ ID NO:18, or the complement thereof.

In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can be used to detect a nucleotide variation within any of the ANGPTL7 variant genomic nucleic acid molecules, ANGPTL7 variant mRNA molecules, and/or ANGPTL7 variant cDNA molecules disclosed herein. The primers described herein can be used to amplify the ANGPTL7 variant genomic nucleic acid molecules, ANGPTL7 variant mRNA molecules, or ANGPTL7 variant cDNA molecules, or a fragment thereof.

The present disclosure also provides pairs of primers comprising any of the primers described above. For example, if one of the primers' 3'-ends hybridizes to a cytosine at a position corresponding to position 4,291 according to SEQ ID NO:1 (rather than a thymine) in a particular ANGPTL7 nucleic acid molecule, then the presence of the amplified fragment would indicate the presence of an ANGPTL7 reference genomic nucleic acid molecule. Conversely, if one of the primers' 3'-ends hybridizes to a thymine at a position corresponding to position 4,291 according to SEQ ID NO:2 (rather than a cytosine) in a particular ANGPTL7 nucleic acid molecule, then the presence of the amplified fragment would indicate the presence of the ANGPTL7 variant genomic nucleic acid molecule. In some embodiments, the nucleotide of the primer complementary to the thymine at a position corresponding to position 4,291 according to SEQ ID NO:2 can be at the 3' end of the primer. In addition, if one of the primers' 3'-ends hybridizes to a cytosine at a position corresponding to position 529 according to SEQ ID NO:7 (rather than a uracil) in a particular ANGPTL7 nucleic acid molecule, then the presence of the amplified fragment would indicate the presence of an ANGPTL7 reference mRNA molecule. Conversely, if one of the primers' 3'-ends hybridizes to a uracil at a position corresponding to position 529 according to SEQ ID NO:8 (rather than a cytosine) in a particular ANGPTL7 mRNA molecule, then the presence of the amplified fragment would indicate the presence of the ANGPTL7 variant mRNA molecule. In some embodiments, the nucleotide of the primer complementary to the uracil at a position corresponding to position 529 according to SEQ ID NO:8 can be at the 3' end of the primer. In addition, if one of the primers' 3'-ends hybridizes to a cytosine at a position corresponding to position 529 according to SEQ ID NO:13 (rather than a thymine) in a particular ANGPTL7 nucleic acid molecule, then the presence of the amplified fragment would indicate the presence of an ANGPTL7 reference cDNA molecule. Conversely, if one of the primers' 3'-ends hybridizes to a thymine at a position corresponding to position 529 according to SEQ ID NO:14 (rather than a cytosine) in a particular ANGPTL7 cDNA molecule, then the presence of the amplified fragment would indicate the presence of the ANGPTL7 variant cDNA molecule. In some embodiments, the nucleotide of the primer complementary to the thymine at a position corresponding to position 529 according to SEQ ID NO:14 can be at the 3' end of the primer.

The present disclosure also provides pairs of primers comprising any of the primers described above. For example, if one of the primers' 3'-ends hybridizes to a guanine at a position corresponding to position 4,287 according to SEQ ID NO:1 (rather than a thymine) in a particular ANGPTL7 nucleic acid molecule, then the presence of the amplified fragment would indicate the presence of an ANGPTL7 reference genomic nucleic acid molecule. Conversely, if one of the primers' 3'-ends hybridizes to a thymine at a position corresponding to position 4,287 according to SEQ ID NO:3 (rather than a guanine) in a particular ANGPTL7 nucleic acid molecule, then the presence of the amplified fragment would indicate the presence of the ANGPTL7 variant genomic nucleic acid molecule. In some embodiments, the nucleotide of the primer complementary to the thymine at a position corresponding to position 4,287 according to SEQ ID NO:3 can be at the 3' end of the primer. In addition, if one of the primers' 3'-ends hybridizes to a guanine at a position corresponding to position 525 according to SEQ ID NO:7 (rather than a uracil) in a particular ANGPTL7 nucleic acid molecule, then the presence of the amplified fragment would indicate the presence of an ANGPTL7 reference mRNA molecule. Conversely, if one of the primers' 3'-ends hybridizes to a uracil at a position corresponding to position 525 according to SEQ ID NO:9 (rather than a guanine) in a particular ANGPTL7 mRNA molecule, then the presence of the amplified fragment would indicate the presence of the ANGPTL7 variant mRNA molecule. In some embodiments, the nucleotide of the primer complementary to the uracil at a position corresponding to position 525 according to SEQ ID NO:9 can be at the 3' end of the primer. In addition, if one of the primers' 3'-ends hybridizes to a guanine at a position corresponding to position 525 according to SEQ ID NO:13 (rather than a thymine) in a particular ANGPTL7 nucleic acid molecule, then the presence of the amplified fragment would indicate the presence of an ANGPTL7 reference cDNA molecule. Conversely, if one of the primers' 3'-ends hybridizes to a thymine at a position corresponding to position 525 according to SEQ ID NO:15 (rather than a guanine) in a particular ANGPTL7 cDNA molecule, then the presence of the amplified fragment would indicate the presence of the ANGPTL7 variant cDNA molecule. In some embodiments, the nucleotide of the primer complementary to the thymine at a position corresponding to position 525 according to SEQ ID NO:15 can be at the 3' end of the primer.

The present disclosure also provides pairs of primers comprising any of the primers described above. For example, if one of the primers' 3'-ends hybridizes to a thymine at a position corresponding to position 4,243 according to SEQ ID NO:1 (rather than an adenine) in a particular ANGPTL7 nucleic acid molecule, then the presence of the amplified fragment would indicate the presence of an ANGPTL7 reference genomic nucleic acid molecule.

Conversely, if one of the primers' 3'-ends hybridizes to an adenine at a position corresponding to position 4,243 according to SEQ ID NO:4 (rather than a thymine) in a particular ANGPTL7 nucleic acid molecule, then the presence of the amplified fragment would indicate the presence of the ANGPTL7 variant genomic nucleic acid molecule. In some embodiments, the nucleotide of the primer complementary to the adenine at a position corresponding to position 4,243 according to SEQ ID NO:4 can be at the 3' end of the primer. In addition, if one of the primers' 3'-ends hybridizes to a uracil at a position corresponding to position 481 according to SEQ ID NO:7 (rather than an adenine) in a particular ANGPTL7 nucleic acid molecule, then the presence of the amplified fragment would indicate the presence of an ANGPTL7 reference mRNA molecule. Conversely, if one of the primers' 3'-ends hybridizes to an adenine at a position corresponding to position 481 according to SEQ ID NO:10 (rather than a uracil) in a particular ANGPTL7 mRNA molecule, then the presence of the amplified fragment would indicate the presence of the ANGPTL7 variant mRNA molecule. In some embodiments, the nucleotide of the primer complementary to the adenine at a position corresponding to position 481 according to SEQ ID NO:10 can be at the 3' end of the primer. In addition, if one of the primers' 3'-ends hybridizes to a thymine at a position corresponding to position 481 according to SEQ ID NO:13 (rather than an adenine) in a particular ANGPTL7 nucleic acid molecule, then the presence of the amplified fragment would indicate the presence of an ANGPTL7 reference cDNA molecule. Conversely, if one of the primers' 3'-ends hybridizes to an adenine at a position corresponding to position 481 according to SEQ ID NO:16 (rather than a thymine) in a particular ANGPTL7 cDNA molecule, then the presence of the amplified fragment would indicate the presence of the ANGPTL7 variant cDNA molecule. In some embodiments, the nucleotide of the primer complementary to the adenine at a position corresponding to position 481 according to SEQ ID NO:16 can be at the 3' end of the primer.

The present disclosure also provides pairs of primers comprising any of the primers described above. For example, if one of the primers' 3'-ends hybridizes to a guanine at a position corresponding to position 4,325 according to SEQ ID NO:1 (rather than an adenine) in a particular ANGPTL7 nucleic acid molecule, then the presence of the amplified fragment would indicate the presence of an ANGPTL7 reference genomic nucleic acid molecule. Conversely, if one of the primers' 3'-ends hybridizes to an adenine at a position corresponding to position 4,325 according to SEQ ID NO:5 (rather than a guanine) in a particular ANGPTL7 nucleic acid molecule, then the presence of the amplified fragment would indicate the presence of the ANGPTL7 variant genomic nucleic acid molecule. In some embodiments, the nucleotide of the primer complementary to the adenine at a position corresponding to position 4,325 according to SEQ ID NO:5 can be at the 3' end of the primer. In addition, if one of the primers' 3'-ends hybridizes to a guanine at a position corresponding to position 563 according to SEQ ID NO:7 (rather than an adenine) in a particular ANGPTL7 nucleic acid molecule, then the presence of the amplified fragment would indicate the presence of an ANGPTL7 reference mRNA molecule. Conversely, if one of the primers' 3'-ends hybridizes to an adenine at a position corresponding to position 563 according to SEQ ID NO:11 (rather than a guanine) in a particular ANGPTL7 mRNA molecule, then the presence of the amplified fragment would indicate the presence of the ANGPTL7 variant mRNA molecule. In some embodiments, the nucleotide of the primer complementary to the adenine at a position corresponding to position 563 according to SEQ ID NO:11 can be at the 3' end of the primer. In addition, if one of the primers' 3'-ends hybridizes to a guanine at a position corresponding to position 563 according to SEQ ID NO:13 (rather than an adenine) in a particular ANGPTL7 nucleic acid molecule, then the presence of the amplified fragment would indicate the presence of an ANGPTL7 reference cDNA molecule. Conversely, if one of the primers' 3'-ends hybridizes to an adenine at a position corresponding to position 563 according to SEQ ID NO:17 (rather than a guanine) in a particular ANGPTL7 cDNA molecule, then the presence of the amplified fragment would indicate the presence of the ANGPTL7 variant cDNA molecule. In some embodiments, the nucleotide of the primer complementary to the adenine at a position corresponding to position 563 according to SEQ ID NO:17 can be at the 3' end of the primer.

The present disclosure also provides pairs of primers comprising any of the primers described above. For example, if one of the primers' 3'-ends hybridizes to an adenine at a position corresponding to position 4,336 according to SEQ ID NO:1 (rather than a cytosine) in a particular ANGPTL7 nucleic acid molecule, then the presence of the amplified fragment would indicate the presence of an ANGPTL7 reference genomic nucleic acid molecule. Conversely, if one of the primers' 3'-ends hybridizes to a cytosine at a position corresponding to position 4,336 according to SEQ ID NO:6 (rather than an adenine) in a particular ANGPTL7 nucleic acid molecule, then the presence of the amplified fragment would indicate the presence of the ANGPTL7 variant genomic nucleic acid molecule. In some embodiments, the nucleotide of the primer complementary to the cytosine at a position corresponding to position 4,336 according to SEQ ID NO:6 can be at the 3' end of the primer. In addition, if one of the primers' 3'-ends hybridizes to an adenine at a position corresponding to position 574 according to SEQ ID NO:7 (rather than a cytosine) in a particular ANGPTL7 nucleic acid molecule, then the presence of the amplified fragment would indicate the presence of an ANGPTL7 reference mRNA molecule. Conversely, if one of the primers' 3'-ends hybridizes to a cytosine at a position corresponding to position 574 according to SEQ ID NO:12 (rather than an adenine) in a particular ANGPTL7 mRNA molecule, then the presence of the amplified fragment would indicate the presence of the ANGPTL7 variant mRNA molecule. In some embodiments, the nucleotide of the primer complementary to the cytosine at a position corresponding to position 574 according to SEQ ID NO:12 can be at the 3' end of the primer. In addition, if one of the primers' 3'-ends hybridizes to an adenine at a position corresponding to position 574 according to SEQ ID NO:13 (rather than a cytosine) in a particular ANGPTL7 nucleic acid molecule, then the presence of the amplified fragment would indicate the presence of an ANGPTL7 reference cDNA molecule. Conversely, if one of the primers' 3'-ends hybridizes to a cytosine at a position corresponding to position 574 according to SEQ ID NO:18 (rather than an adenine) in a particular ANGPTL7 cDNA molecule, then the presence of the amplified fragment would indicate the presence of the ANGPTL7 variant cDNA molecule. In some embodiments, the nucleotide of the primer complementary to the cytosine at a position corresponding to position 574 according to SEQ ID NO:18 can be at the 3' end of the primer.

In the context of the present disclosure "specifically hybridizes" means that the probe or primer (such as, for example, the alteration-specific probe or alteration-specific primer) does not hybridize to a nucleic acid sequence encoding an ANGPTL7 reference genomic nucleic acid molecule, an ANGPTL7 reference mRNA molecule, and/or an ANGPTL7 reference cDNA molecule.

In some embodiments, the probes (such as, for example, an alteration-specific probe) comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well.

The nucleotide sequence of an ANGPTL7 reference genomic nucleic acid molecule is set forth in SEQ ID NO:1. Referring to SEQ ID NO:1, position 4,291 is a cytosine. Referring to SEQ ID NO:1, position 4,287 is a guanine. Referring to SEQ ID NO:1, position 4,243 is a thymine. Referring to SEQ ID NO:1, position 4,325 is a guanine. Referring to SEQ ID NO:1, position 4,336 is an adenine.

A variant genomic nucleic acid molecule of ANGPTL7 exists, wherein the cytosine at position 4,291 is replaced with a thymine. The nucleotide sequence of this ANGPTL7 variant genomic nucleic acid molecule is set forth in SEQ ID NO:2.

Another variant genomic nucleic acid molecule of ANGPTL7 exists, wherein the guanine at position 4,287 is replaced with a thymine. The nucleotide sequence of this ANGPTL7 variant genomic nucleic acid molecule is set forth in SEQ ID NO:3.

Another variant genomic nucleic acid molecule of ANGPTL7 exists, wherein the thymine at position 4,243 is replaced with an adenine. The nucleotide sequence of this ANGPTL7 variant genomic nucleic acid molecule is set forth in SEQ ID NO:4.

Another variant genomic nucleic acid molecule of ANGPTL7 exists, wherein the guanine at position 4,325 is replaced with an adenine. The nucleotide sequence of this ANGPTL7 variant genomic nucleic acid molecule is set forth in SEQ ID NO:5.

Another variant genomic nucleic acid molecule of ANGPTL7 exists, wherein the adenine at position 4,336 is replaced with a cytosine. The nucleotide sequence of this ANGPTL7 variant genomic nucleic acid molecule is set forth in SEQ ID NO:6.

The nucleotide sequence of an ANGPTL7 reference mRNA molecule is set forth in SEQ ID NO:7. Referring to SEQ ID NO:7, position 529 is a cytosine. Referring to SEQ ID NO:7, position 525 is a guanine. Referring to SEQ ID NO:7, position 481 is a uracil. Referring to SEQ ID NO:7, position 563 is a guanine. Referring to SEQ ID NO:7, position 574 is an adenine.

A variant mRNA molecule of ANGPTL7 exists, wherein the cytosine at position 529 is replaced with a uracil. The nucleotide sequence of this ANGPTL7 variant mRNA molecule is set forth in SEQ ID NO:8.

Another variant mRNA molecule of ANGPTL7 exists, wherein the guanine at position 525 is replaced with a uracil. The nucleotide sequence of this ANGPTL7 variant mRNA molecule is set forth in SEQ ID NO:9.

Another variant mRNA molecule of ANGPTL7 exists, wherein the uracil at position 481 is replaced with an adenine. The nucleotide sequence of this ANGPTL7 variant mRNA molecule is set forth in SEQ ID NO:10.

Another variant mRNA molecule of ANGPTL7 exists, wherein the guanine at position 563 is replaced with an adenine. The nucleotide sequence of this ANGPTL7 variant mRNA molecule is set forth in SEQ ID NO:11.

Another variant mRNA molecule of ANGPTL7 exists, wherein the adenine at position 574 is replaced with a cytosine. The nucleotide sequence of this ANGPTL7 variant mRNA molecule is set forth in SEQ ID NO:12.

The nucleotide sequence of an ANGPTL7 reference cDNA molecule is set forth in SEQ ID NO:13. Referring to SEQ ID NO:13, position 529 is a cytosine. Referring to SEQ ID NO:13, position 525 is a guanine. Referring to SEQ ID NO:13, position 481 is a thymine. Referring to SEQ ID NO:13, position 563 is a guanine. Referring to SEQ ID NO:13, position 574 is an adenine.

A variant cDNA molecule of ANGPTL7 exists, wherein the cytosine at position 529 is replaced with a thymine. The nucleotide sequence of this ANGPTL7 variant cDNA molecule is set forth in SEQ ID NO:14.

Another variant cDNA molecule of ANGPTL7 exists, wherein the guanine at position 525 is replaced with a thymine. The nucleotide sequence of this ANGPTL7 variant cDNA molecule is set forth in SEQ ID NO:15.

Another variant cDNA molecule of ANGPTL7 exists, wherein the thymine at position 481 is replaced with an adenine. The nucleotide sequence of this ANGPTL7 variant cDNA molecule is set forth in SEQ ID NO:16.

Another variant cDNA molecule of ANGPTL7 exists, wherein the guanine at position 563 is replaced with an adenine. The nucleotide sequence of this ANGPTL7 variant cDNA molecule is set forth in SEQ ID NO:17.

Another variant cDNA molecule of ANGPTL7 exists, wherein the adenine at position 574 is replaced with a cytosine. The nucleotide sequence of this ANGPTL7 variant cDNA molecule is set forth in SEQ ID NO:18.

The genomic nucleic acid molecules, mRNA molecules, and cDNA molecules can be from any organism. For example, the genomic nucleic acid molecules, mRNA molecules, and cDNA molecules can be human or an ortholog from another organism, such as a non-human mammal, a rodent, a mouse, or a rat. It is understood that gene sequences within a population can vary due to polymorphisms such as single-nucleotide polymorphisms. The examples provided herein are only exemplary sequences. Other sequences are also possible.

Also provided herein are functional polynucleotides that can interact with the disclosed nucleic acid molecules. Examples of functional polynucleotides include, but are not limited to, antisense molecules, aptamers, ribozymes, triplex forming molecules, and external guide sequences. The functional polynucleotides can act as effectors, inhibitors, modulators, and stimulators of a specific activity possessed by a target molecule, or the functional polynucleotides can possess a de novo activity independent of any other molecules.

The isolated nucleic acid molecules disclosed herein can comprise RNA, DNA, or both RNA and DNA. The isolated nucleic acid molecules can also be linked or fused to a heterologous nucleic acid sequence, such as in a vector, or a heterologous label. For example, the isolated nucleic acid molecules disclosed herein can be within a vector or as an exogenous donor sequence comprising the isolated nucleic acid molecule and a heterologous nucleic acid sequence. The isolated nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, $-O[(CH_2)_nO]_mCH_3$, $-O(CH_2)_nOCH_3$, $-O(CH_2)_nNH_2$, $-O(CH_2)_nCH_3$, $-O(CH_2)_n-ONH_2$, and $-O(CH_2)_nON[(CH_2)_nCH_3)]_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

The present disclosure also provides vectors comprising any one or more of the nucleic acid molecules disclosed herein. In some embodiments, the vectors comprise any one or more of the nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

Desired regulatory sequences for mammalian host cell expression can include, for example, viral elements that direct high levels of polypeptide expression in mammalian cells, such as promoters and/or enhancers derived from retroviral LTRs, cytomegalovirus (CMV) (such as, for example, CMV promoter/enhancer), Simian Virus 40 (SV40) (such as, for example, SV40 promoter/enhancer), adenovirus, (such as, for example, the adenovirus major late promoter (AdMLP)), polyoma and strong mammalian promoters such as native immunoglobulin and actin promoters. Methods of expressing polypeptides in bacterial cells or fungal cells (such as, for example, yeast cells) are also well known. A promoter can be, for example, a constitutively active promoter, a conditional promoter, an inducible promoter, a temporally restricted promoter (such as, for example, a developmentally regulated promoter), or a spatially restricted promoter (such as, for example, a cell-specific or tissue-specific promoter).

Percent identity (or percent complementarity) between particular stretches of nucleotide sequences within nucleic acid molecules or amino acid sequences within polypeptides can be determined routinely using BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489). Herein, if reference is made to percent sequence identity, the higher percentages of sequence identity are preferred over the lower ones.

The present disclosure also provides compositions comprising any one or more of the isolated nucleic acid molecules, genomic nucleic acid molecules, mRNA molecules, and/or cDNA molecules disclosed herein. In some embodiments, the composition is a pharmaceutical composition. In some embodiments, the compositions comprise a carrier and/or excipient. Examples of carriers include, but are not limited to, poly(lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

As used herein, the phrase "corresponding to" or grammatical variations thereof when used in the context of the numbering of a particular nucleotide or nucleotide sequence or position refers to the numbering of a specified reference sequence when the particular nucleotide or nucleotide sequence is compared to a reference sequence (such as, for example, SEQ ID NO:1, SEQ ID NO:7, or SEQ ID NO:13). In other words, the residue (such as, for example, nucleotide or amino acid) number or residue (such as, for example, nucleotide or amino acid) position of a particular polymer is designated with respect to the reference sequence rather than by the actual numerical position of the residue within the particular nucleotide or nucleotide sequence. For example, a particular nucleotide sequence can be aligned to a reference sequence by introducing gaps to optimize residue matches between the two sequences. In these cases, although the gaps are present, the numbering of the residue in the particular nucleotide or nucleotide sequence is made with respect to the reference sequence to which it has been aligned.

For example, a nucleic acid molecule comprising a nucleotide sequence encoding an ANGPTL7 polypeptide, wherein the nucleotide sequence comprises a thymine at a position corresponding to position 4,291 according to SEQ ID NO:2 means that if the nucleotide sequence of the ANGPTL7 genomic nucleic acid molecule is aligned to the sequence of SEQ ID NO:2, the ANGPTL7 sequence has a thymine residue at the position that corresponds to position 4,291 of SEQ ID NO:2. The same applies for mRNA molecules comprising a nucleotide sequence encoding an ANGPTL7 polypeptide, wherein the nucleotide sequence comprises a uracil at a position corresponding to position 529 according to SEQ ID NO:8, and cDNA molecules comprising a nucleotide sequence encoding an ANGPTL7 polypeptide, wherein the nucleotide sequence comprises a thymine at a position corresponding to position 529 according to SEQ ID NO:14. In other words, these phrases refer to a nucleic acid molecule encoding an ANGPTL7 polypeptide, wherein the genomic nucleic acid molecule has a nucleotide sequence that comprises a thymine residue that is homologous to the thymine residue at position 4,291 of SEQ ID NO:2 (or wherein the mRNA molecule has a nucleotide sequence that comprises a uracil residue that is homologous to the uracil residue at position 529 of SEQ ID NO:8, or wherein the cDNA molecule has a nucleotide sequence that comprises a thymine residue that is homologous to the thymine residue at position 529 of SEQ ID NO:14). Herein, the polypeptide produced from such nucleic acid molecules is referred to herein as "Arg177STOP."

As described herein, a position within an ANGPTL7 genomic nucleic acid molecule that corresponds to position 4,291 according to SEQ ID NO:2, for example, can be identified by performing a sequence alignment between the nucleotide sequence of a particular ANGPTL7 nucleic acid molecule and the nucleotide sequence of SEQ ID NO:2. A variety of computational algorithms exist that can be used for performing a sequence alignment to identify a nucleotide position that corresponds to, for example, position 4,291 in SEQ ID NO:2. For example, by using the NCBI BLAST algorithm (Altschul et al., Nucleic Acids Res., 1997, 25, 3389-3402) or CLUSTALW software (Sievers and Higgins, Methods Mol. Biol., 2014, 1079, 105-116) sequence alignments may be performed. However, sequences can also be aligned manually.

The amino acid sequence of an ANGPTL7 reference polypeptide is set forth in SEQ ID NO:19. Referring to SEQ ID NO:19, the ANGPTL7 reference polypeptide is 346 amino acids in length. Referring to SEQ ID NO:19, position 175 is a glutamine. Referring to SEQ ID NO:19, position 177 is an arginine. Referring to SEQ ID NO:19, position 161 is a phenylalanine. Referring to SEQ ID NO:19, position 188 is a tryptophan. Referring to SEQ ID NO:19, position 192 is a lysine.

A variant polypeptide of ANGPTL7 exists (Arg177STOP), the amino acid sequence of which is set forth in SEQ ID NO:20. Referring to SEQ ID NO:20, the ANGPTL7 variant polypeptide terminates at position 176. Thus, this variant is 176 amino acids in length. Referring to SEQ ID NO:20, the ANGPTL7 variant polypeptide does not contain amino acids at positions corresponding to positions 177 to 346 of SEQ ID NO:19.

Another variant polypeptide of ANGPTL7 exists (Gln175His), the amino acid sequence of which is set forth in SEQ ID NO:21. Referring to SEQ ID NO:21, the ANGPTL7 variant polypeptide is 346 amino acids in length. Referring to SEQ ID NO:21, position 175 is a histidine.

Another variant polypeptide of ANGPTL7 exists (Phe161Ile), the amino acid sequence of which is set forth in SEQ ID NO:22. Referring to SEQ ID NO:22, the ANGPTL7 variant polypeptide is 346 amino acids in length. Referring to SEQ ID NO:22, position 161 is an isoleucine.

A variant polypeptide of ANGPTL7 exists (Trp188STOP), the amino acid sequence of which is set forth in SEQ ID NO:23. Referring to SEQ ID NO:23, the ANGPTL7 variant polypeptide terminates at position 187. Thus, this variant is 187 amino acids in length. Referring to SEQ ID NO:23, the ANGPTL7 variant polypeptide does not contain amino acids at positions corresponding to positions 188 to 346 of SEQ ID NO:19.

Another variant polypeptide of ANGPTL7 exists (Lys192Gln), the amino acid sequence of which is set forth in SEQ ID NO:24. Referring to SEQ ID NO:24, the ANGPTL7 variant polypeptide is 346 amino acids in length. Referring to SEQ ID NO:24, position 192 is a glutamine.

The present disclosure also provides combinations of a glucocorticoid and an ANGPTL7 inhibitor for use in the treatment of inflammation. The present disclosure also provides combinations of a glucocorticoid and an ANGPTL7 inhibitor for use in the preparation of a medicament for treating inflammation. In any of the embodiments described herein, the subject is identified as having any of the ANGPTL7 variant nucleic acid molecules and/or polypeptides described herein. The glucocorticoid can be any of the glucocorticoids described herein. The ANGPTL7 inhibitors can be any of the ANGPTL7 inhibitors described herein. The combinations of a glucocorticoid and an ANGPTL7 inhibitor can be used to treat or prevent a glucocorticoid-induced ophthalmic condition in a subject who is undergoing or will be undergoing glucocorticoid treatment, such as for inflammation.

The present disclosure also provides ANGPTL7 inhibitors for use in decreasing or preventing a glucocorticoid-induced ophthalmic condition in a subject undergoing glucocorticoid treatment. The present disclosure also provides ANGPTL7 inhibitors for use in the preparation of a medicament for decreasing or preventing a glucocorticoid-induced ophthalmic condition in a subject undergoing glucocorticoid treatment. In any of the embodiments described herein, the subject is identified as having any of the ANGPTL7 variant nucleic acid molecules and/or polypeptides described herein. The glucocorticoid treatment can be treatment with any of the glucocorticoids described herein. The ANGPTL7 inhibitors can be any of the ANGPTL7 inhibitors described herein. The glucocorticoid-induced ophthalmic condition can be any of the glucocorticoid-induced ophthalmic conditions described herein.

In any of the embodiments described herein, the subject is identified as having a genomic nucleic acid molecule having a nucleotide sequence encoding an ANGPTL7 polypeptide, wherein the nucleotide sequence comprises: a thymine at a position corresponding to position 4,291 according to SEQ ID NO:2, or the complement thereof; a thymine at a position corresponding to position 4,287 according to SEQ ID NO:3, or the complement thereof; an adenine at a position corresponding to position 4,243 according to SEQ ID NO:4, or the complement thereof; an adenine at a position corresponding to position 4,325 according to SEQ ID NO:5, or the complement thereof; or a cytosine at a position corresponding to position 4,336 according to SEQ ID NO:6, or the complement thereof. In any of the embodiments described herein, the subject is identified as having an mRNA molecule having a nucleotide sequence encoding an ANGPTL7 polypeptide, wherein the nucleotide sequence comprises: a uracil at a position corresponding to position 529 according to SEQ ID NO:8, or the complement thereof; a uracil at a position corresponding to position 525 according to SEQ ID NO:9, or the complement thereof; an adenine at a position corresponding to position 481 according to SEQ ID NO:10, or the complement thereof; an adenine at a position corresponding to position 563 according to SEQ ID NO:11, or the complement thereof; or a cytosine at a position corresponding to position 574 according to SEQ ID NO:12, or the complement thereof. In any of the embodiments described herein, the subject is identified as having a cDNA molecule having a nucleotide sequence encoding an ANGPTL7 polypeptide, wherein the nucleotide sequence comprises: a thymine at a position corresponding to position 529 according to SEQ ID NO:14, or the complement thereof; a thymine at a position corresponding to position 525 according to SEQ ID NO:15, or the complement thereof; an adenine at a position corresponding to position 481 according to SEQ ID NO:16, or the complement thereof; an adenine at a position corresponding to position 563 according to SEQ ID NO:17, or the complement thereof; or a cytosine at a position corresponding to position 574 according to SEQ ID NO:18, or the complement thereof.

In some embodiments, the subject can have inflammation. In some embodiments, the inflammation can be acute inflammation or chronic inflammation. In some embodiments, the inflammation is acute inflammation. In some embodiments, the inflammation is chronic inflammation. In some embodiments, the inflammation is associated with rheumatoid arthritis, associated with Grave's disease, or is ophthalmic inflammation. In some embodiments, the inflammation is associated with rheumatoid arthritis. In some embodiments, the inflammation is associated with Grave's disease. In some embodiments, the inflammation is ophthalmic inflammation. In some embodiments, the ophthalmic inflammation is chosen from uveitis, juvenile idiopathic arthritis uveitis, scleritis, blepharitis, conjunctivitis, iritis, and episcleritis, or any combination thereof. In some embodiments, the ophthalmic inflammation is uveitis. In some embodiments, the ophthalmic inflammation is juvenile idiopathic arthritis uveitis. In some embodiments, the ophthalmic inflammation is scleritis. In some embodiments, the ophthalmic inflammation is blepharitis. In some embodiments, the ophthalmic inflammation is conjunctivitis. In some embodiments, the ophthalmic inflammation is iritis. In some embodiments, the ophthalmic inflammation is episcleritis.

In some embodiments, the glucocorticoid-induced ophthalmic condition is chosen from ocular hypertension, increased intraocular pressure (IOP), pre-glaucoma, glaucoma, decreased corneal hysteresis, and posterior subcapsular cataracts, or any combination thereof. In some embodiments, the glucocorticoid-induced ophthalmic condition is ocular hypertension. In some embodiments, the glucocorticoid-induced ophthalmic condition is increased IOP. In some embodiments, the glucocorticoid-induced ophthalmic condition is pre-glaucoma. In some embodiments, the glucocorticoid-induced ophthalmic condition is glaucoma. In some embodiments, the glucocorticoid-induced ophthalmic condition is decreased corneal hysteresis. In some embodiments, the glucocorticoid-induced ophthalmic condition is posterior subcapsular cataracts.

In some embodiments, the glucocorticoid treatment is treatment with prednisone, prednisolone, methylprednisolone, dexamethasone, betamethasone, triamcinolone, beclometasone, fludrocortisone acetate, DOCA, aldosterone, budesonide, mometasone furoate, fluticasone propionate, hydrocortisone, cortisone acetate, or fluticasone furoate, difluprednate ophthalmic, fluorometholone, loteprednol etabonate, medrysone, rimexolone, fluocinolone acetonide, clobetasol, halobetasol, diflorasone, fluocinonide, flurandrenolide, Neo-Poly-Dex, tobramycin-dexamethasone, difluprednate, or any combination thereof. In some embodiments, the glucocorticoid treatment is treatment with prednisone. In some embodiments, the glucocorticoid treatment is treatment with prednisolone. In some embodiments, the glucocorticoid treatment is treatment with methylprednisolone. In some embodiments, the glucocorticoid treatment is treatment with dexamethasone. In some embodiments, the glucocorticoid treatment is treatment with betamethasone. In some embodiments, the glucocorticoid treatment is treatment with triamcinolone. In some embodiments, the glucocorticoid treatment is treatment with beclomethasone. In some embodiments, the glucocorticoid treatment is treatment with fludrocortisone acetate. In some embodiments, the glucocorticoid treatment is treatment with DOCA. In some embodiments, the glucocorticoid treatment is treatment with aldosterone. In some embodiments, the glucocorticoid treatment is treatment with budesonide. In some embodiments, the glucocorticoid treatment is treatment with mometasone furoate. In some embodiments, the glucocorticoid treatment is treatment with fluticasone propionate. In some embodiments, the glucocorticoid treatment is treatment with hydrocortisone. In some embodiments, the glucocorticoid treatment is treatment with cortisone acetate. In some embodiments, the glucocorticoid treatment is treatment with fluticasone furoate. In some embodiments, the glucocorticoid treatment is treatment with difluprednate ophthalmic. In some embodiments, the glucocorticoid treatment is treatment with fluorometholone. In some embodiments, the glucocorticoid treatment is treatment with loteprednol etabonate. In some embodiments, the glucocorticoid treatment is treatment with medrysone. In some embodiments, the glucocorticoid treatment is treatment with rimexolone. In some embodiments, the glucocorticoid treatment is treatment with fluocinolone acetonide. In some embodiments, the glucocorticoid treatment is treatment with clobetasol. In some embodiments, the glucocorticoid treatment is treatment with halobetasol. In some embodiments, the glucocorticoid treatment is treatment with diflorasone. In some embodiments, the glucocorticoid treatment is treatment with fluocinonide. In some embodiments, the glucocorticoid treatment is treatment with flurandrenolide. In some embodiments, the glucocorticoid treatment is treatment with Neo-Poly-Dex. In some embodiments, the glucocorticoid treatment is treatment with tobramycin-dexamethasone. In some embodiments, the glucocorticoid treatment is treatment with difluprednate.

In some embodiments, the ANGPTL7 inhibitor comprises an inhibitory nucleic acid molecule. In some embodiments, the inhibitory nucleic acid molecule comprises an antisense nucleic acid molecule, an siRNA, or an shRNA that hybridizes to an ANGPTL7 nucleic acid molecule. In some embodiments, the inhibitory nucleic acid molecule comprises an antisense nucleic acid molecule. In some embodiments, the inhibitory nucleic acid molecule comprises an siRNA. In some embodiments, the inhibitory nucleic acid molecule comprises an shRNA.

In some embodiments, the ANGPTL7 inhibitor comprises a Cas protein and gRNA that hybridizes to a gRNA recognition sequence within an ANGPTL7 genomic nucleic acid molecule. In some embodiments, the Cas protein is Cas9 or Cpf1. In some embodiments, the gRNA recognition sequence includes or is proximate to a position corresponding to: position 4,291 according to SEQ ID NO:1, position 4,287 according to SEQ ID NO:1, position 4,243 according to SEQ ID NO:1, position 4,325 according to SEQ ID NO:1, or position 4,336 according to SEQ ID NO:1. In some embodiments, the gRNA recognition sequence is located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 4,291 according to SEQ ID NO:1, position 4,287 according to SEQ ID NO:1, position 4,243 according to SEQ ID NO:1, position 4,325 according to SEQ ID NO:1, or position 4,336 according to SEQ ID NO:1. In some embodiments, a PAM sequence is about 2 to about 6 nucleotides downstream of the gRNA recognition sequence. In some embodiments, the gRNA comprises from about 17 nucleotides to about 23 nucleotides. In some embodiments, the gRNA recognition sequence comprises a nucleotide sequence according to any one of SEQ ID NOs:25-165.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in °C. or is at ambient temperature, and pressure is at or near atmospheric.

EXAMPLES

Example 1: ANGPTL7 KO Mice Inhibit DEX-Ac-Induced Ocular Hypertension in Mice

Weekly periocular CF injections of DEX-Ac in both eyes in ANGPTL7 WT mice significantly elevated IOP in (see, FIG. 1). IOP measurements of DEX-Ac-treated (n=18) versus vehicle-treated (n=6) mice show IOP elevation from week 1 to 6; $p<0.01$, *$p<0.001$, ****$p<0.0001$. In contrast, weekly periocular CF injections of DEX-Ac in both eyes in ANGPTL7 KO mice did not elevate IOP (see, FIG. 1). IOP measurements of DEX-Ac-treated (n=20) versus vehicle-treated (n=12) ANGPTL7 KO mice showed no effect in IOP elevation from week 1 to week 6.

Example 2: In Vivo Evaluation of ANGPTL7 siRNA in Wild-Type Mice dsRNA were assessed for their ability to reduce the level of ANGPTL7 RNAs and/or reduce IOP in vivo in wild-type mice.

Six different siRNAs targeting ANGPTL7 (siRNA #1-6; see below) were tested in C57BL/6J wild-type mice and IOP was monitored over time. C57BL/6J mice were each intravitreally injected with 15 μg of an siRNA or PBS control. Animals in the naïve group received no injection. Six weeks later, animals were sacrificed, eyes were collected, and limbal rings were carefully micro-dissected. qPCR was performed on limbal rings dissected from mouse eyes enriched for the travecular meshwork (TM) for ANGPTL7 expression. The data were expressed as percent message remaining relative to the baseline value, and presented as mean±standard error of the mean (SEM).

| Duplex # | sense strand sequence | antisense strand sequence |
|---|---|---|
| #1 | UUGGGCAAUGAACUGAACAGA (SEQ ID NO: 5559) | UCUGUUCAGUUCAUUGCCCAACG (SEQ ID NO: 5560) |
| #2 | GUACCAGAAGAACUACCGAAA (SEQ ID NO: 5535) | UUUCGGUAGUUCUUCUGGUACAG (SEQ ID NO: 5536) |
| #3 | AGACAGUAUAAGCAAGGGUUA (SEQ ID NO: 5555) | UAACCCUUGCUUAUACUGUCUCC (SEQ ID NO: 5556) |
| #4 | GCAGAAGCCUCAUAAACGCAA (SEQ ID NO: 5573) | UUGCGUUUAUGAGGCUUCUGCAG (SEQ ID NO: 5574) |
| #5 | ACACUUCCUUGUGUCUAUAGA (SEQ ID NO: 5533) | UCUAUAGACACAAGGAAGUGUCG (SEQ ID NO: 5534) |
| #6 | CUGCAGAAGCCUCAUAAACGA (SEQ ID NO: 5571) | UCGUUUAUGAGGCUUCUGCAGCC (SEQ ID NO: 5572) |

Figure 2:
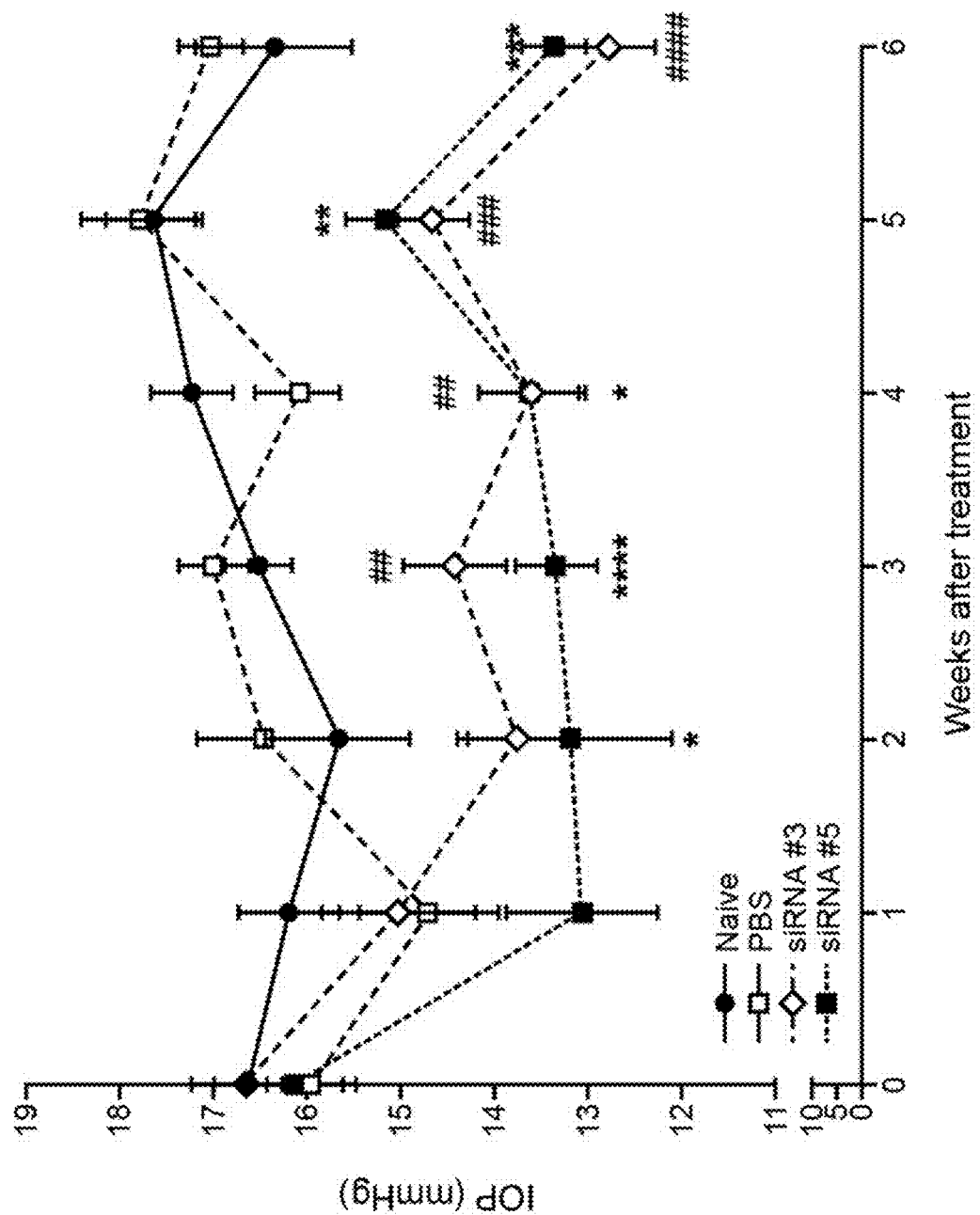
FIG. 2 depicts effect of ANGPTL7 siRNA on intraocular pressure (IOP) of wild-type mice. Intravitreal injection with 15 μg of ANGPTL7-siRNA significantly lowered IOP in two of six siRNAs tested (n=6-8/group) compared to the PBS-treated (n=6) and naïve (no injection, n=5) groups starting at week 2 and through the end of the study. Error bars represent standard error of the mean (SEM).
Figure 3:
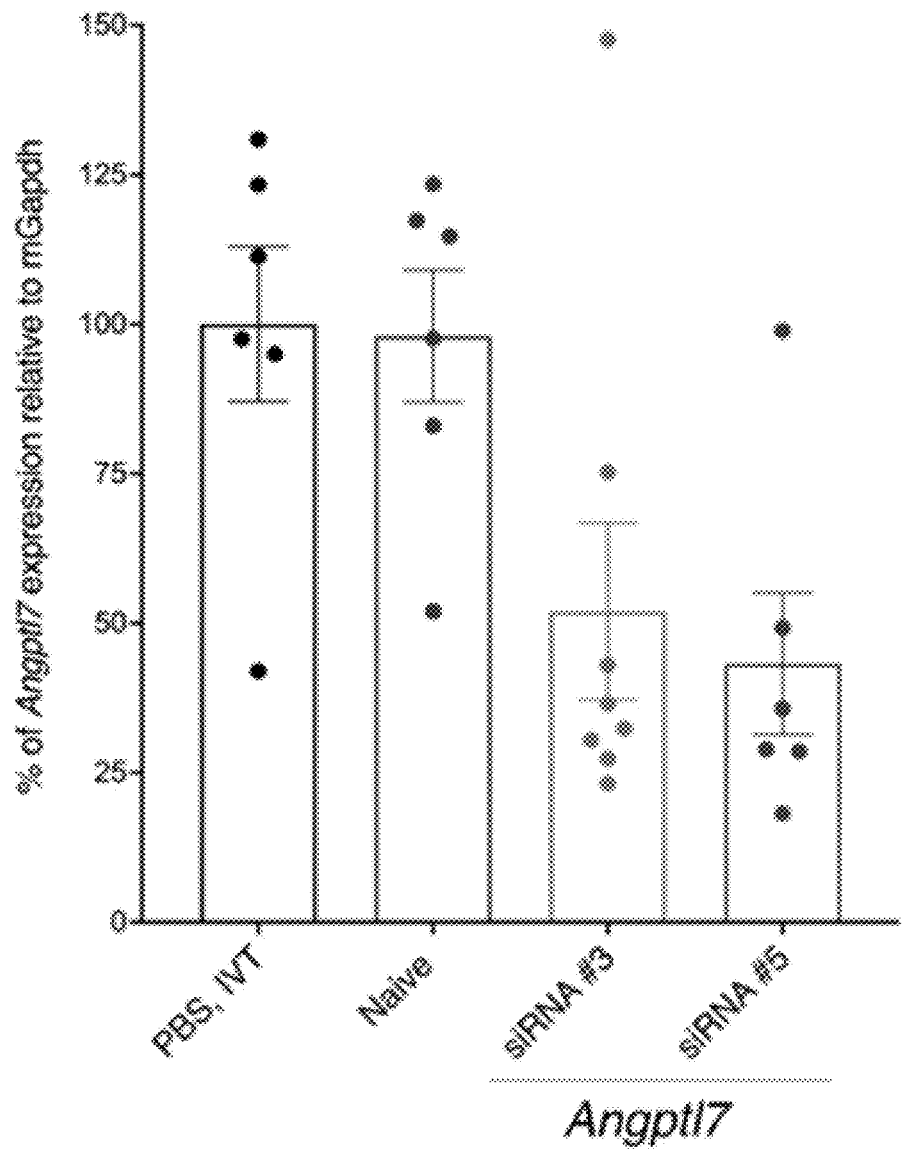
FIG. 3 depicts effect of ANGPTL7 siRNA on ANGPTL7 expression in the limbal ring of wild-type mice in vivo. qPCR results from micro-dissected limbal ring showed the highest level of knockdown (>50%) of ANGPTL7 mRNA with siRNAs #3 and #5 compared to PBS-treated or naïve (no injection) mice, which is consistent with the IOP lowering observed in mice injected with one of these two siRNAs (shown in FIG. 1). Error bars represent SEM.

The results of the in vivo evaluation are shown in FIGS. 2 and 3. As shown in FIG. 2, IOP was significantly lowered 2 weeks post-injection in mice treated with two of the six siRNAs (siRNA #3 and #5, n=6-8/group) compared to the PBS-treated (n=6) or naïve (no injection, n=5) groups. Naïve and PBS-treated animals maintained their IOPs at baseline for the duration of the study (weeks 0-6). In contrast, in mice treated with siRNA #3 and #5, IOP was lowered by 2-4 mmHg starting at week 2 compared to PBS-treated or naïve mice, and remained lowered through the end of the study (i.e., 6 weeks).

As shown in FIG. 3, in qPCR of the limbal ring tissue harvested at the end of the study (i.e., 6 weeks after the siRNA administration), the highest level of knockdown (>50%) of ANGPTL7 mRNA was observed with siRNAs #3 and #5 compared to PBS-treated or naïve mice. Such mRNA knockdown effect is consistent with the lowering of IOP observed in mice injected with one of these two siRNAs. The results suggest that inhibition of ANGPTL7 expression also lowers IOP, and demonstrate the ability of the exemplary dsRNA agents to reduce the ANGPTL7 expression and also lower IOP in vivo.

Figure 4:
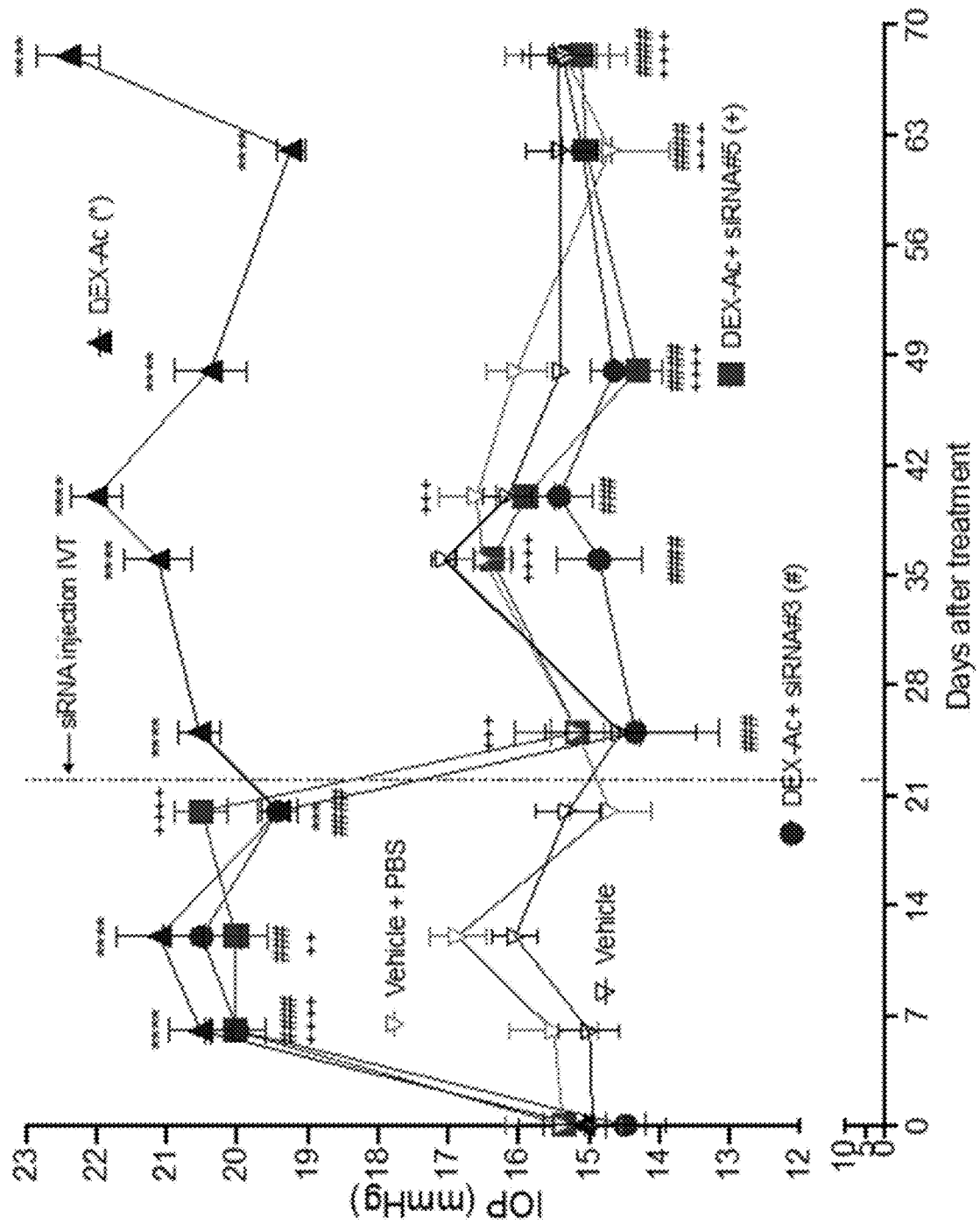
FIG. 4 depicts effect of ANGPTL7 siRNA on reducing dexamethasone-21-acetate (DEX-Ac)-induced ocular hypertension.

Example 3: In Vivo Knock Down of ANGPTL7 by siRNA in Wild Type Mice Inhibits Steroid-Induced and Other Types of TM-Stress Related IOP Elevation in Glaucoma dsRNA were further assessed for their ability to reduce steroid induced IOP in vivo in wild-type mice. Weekly periocular CF injections of DEX-Ac suspension to both eyes caused DEX-induced OHT with sustained and significantly elevated IOP in WT mice. Mice were divided into following groups as shown in FIG. 4: a) Vehicle (n=4), b) Vehicle+PBS (n=6), c) DEX-Ac (n=12), d) DEX-Ac+siRNA #3 (n=14), and e) DEX-Ac+siRNA #5 (n=14). IOP elevation was rapid and significantly higher in DEX-Ac-treated mice compared with vehicle-treated mice starting 6-days post-injection. DEX-Ac treated mice in group c developed DEX-induced OHT with sustained and significantly elevated IOP throughout the study. At Day 22, siRNA targeting ANGPTL7 (#3 and #5) were intravitreally injected into groups: d and e (DEX-Ac+siRNA #3 and DEX-Ac+siRNA #5) and IOP measurements continued to be recorded. In groups d and e, IOPs were significantly reduced and returned to baseline IOP within one week as compared with DEX-Ac treated group (c). The IOP remained at baseline throughout the study even though these mice continued to receive weekly DEX-Ac treatment.

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety and for all purposes.

SEQUENCE LISTING (5846 sequences)

SEQ ID NO: 1 - DNA, 6641 bp, homo sapien
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcaggtaaggagaccagtcccctgagggagcgtggagtgcctccccatctacagcactgcttctacatatcctggtcatcagaaccactactggggcctcttttgtgggtacactttccctttagtaaaggcttatgcagtatttcctttgacttctaatgctatgtaagtttacctaacaccttcacgggtctcttttatccacacagtgtttcagcctaccatcttggagtgctgagatactacatggtttgcccaaagtcacccagcaagtcttagaagcagggttcaagtcttcctgattggtgtagctctgctacttcctcaccaagagctgacaggctatatctcaagaaattccaaggaagcaccaaactgtaacagctgttcctctggaagcaaagttttgccagaaacagttctctggtgttcctaagatttaccaggaatgagcattaatggaattttgtgtcctctctctgtaaacgtaactcttctcattggctcagagttaagtgtagagacacataaccatgtgaagagtccctttgtgttcaggaaggatgcggctccttaaggttcctcaattgtgatacgtctatttttttccatggtcttaaatgaatttctccgaatacaggattttttaaatgcaatgctgaaatatagacttaataggccaaaaataagataaatttaatctttcttttgcaaaataacttttatttctggttagctcagctcaggtgggccaacatgaatttacggtttagagataaaaatttggttttctgaaattatcaggaaaatattagttgtaaggagcatatcctatagacatgtcatttcttgctgatataaaaaccattggtcccattataaactacatgaagaacaaagacatgatcagcttctactgactaagtcaatggttaacctcagctcaaattaagaaaaagttttaacatgaaaccaagcttgaaaattctgttacctgaaccaacatgtatcaatcactttctaagcatggacttccgggccctcagtttgggattagaaaggtattctcaggccattttccagacaagtgagtcctgatttggtctgtgagatgaaaccagacatgcggaagaccaggccagacagaggaatctgaccgtgccacttcctgctcatccaaacaggaggctttctcaccatcctgcaaggaggttcttggggtcaagtgcagctctcccaccaggtctcttgctcttcttgcccaggacatcattccttatttttcttctctatgaccaagtgctcagttacccttatattctataagtaggtagtcccttagaggaagcagtaagttggtgctttcaccactaagacgaaatgaagaatagtgatggcgaaggcacacgtactctacctccctttcccaaggtgctctgcaagagaacctatgtgcctcagacaactcccatctgccatcttggtgctcctctctaaggtcccagtgcagtggtcaccaagaaaagcaccccgagacatagcaggcaggaagcttctcttggatagtaagggccgcagtctctgaatcctatcagaaaaggctgtctcttccactatgctctttgatatttagaatacagagcttaaatcctgcataaagtagcagctccatggccctagagtaaaaaaactggccagtctgatgctctcatttcattgttttaacaaaacttctgggaggaaggcctcaaaggttcttctgagtgttttgaggtgctagctggatggaaggggaaaatatgtgataataaaatctatctcccttaattatggtctcaggtggcagtagccaccatctctgaacaacaacaaaaacaaccaaccaggaaacatcaacaaaaccagactctatgagatattcacgactgatttgttatagtggcggctgtctaagaagtctgaatctatctgacaggagtatctgttacgtggccctcatacactgtaacatttctagaattcatggcccagctatagcagaataatttatttcagagttaacctgaaaccacctgttggaacgtcccactaatgctatccaggtgaagggcttccctacccctctgctccaccgctagtaaagccaaaatacaccccctctggatctccccatatccacctctcccaaatgcagacactgatgggtaattaacaccactgagaatcccagggtagaaataaaggctcagtctctaaacactcaactcagatggagccactgggtctaaatgctcaccctgtggtttgttctcttgtagatgccatctacgactgctcttccctctaccagaagaactaccgcatctctggagtgtataagcttcctcctgatgacttcctgggcagccctgaactggaggtgaggtcattacagtcactggccatgccctaatacctgtccttcaccccctcaaggggactacaacaacagggccattcacagtttaaagaaaggaaaattcggctgggcgcagtggctcacacctgtaatcccagcactatgggaggccgaggcaggtggatcacttcaggtcaggagtttaagaccagcctggccaacatggtgaaaccctgtctctactaaaaatacaaaaaaattagccaggcatggtggtgggcacctgtaatccctgctacacaggaggattgcttgaactcaggaggcagaggttgcagtgagccgagatcacgccactgcactataatctgggagacaaagtgagactccatttcaattaaaaaaaaaaaaaaaaaaaaggaaaactcaaacacaagcaaacacaccaaacaccacagagctatgcaaacactcagtttatgccctgcactccaaacccaggcatctgtttggccccttcaaatcattatcagtcaaacaacaagccttctaacatagatcagatcattcttataaccaccacataacttagtttaaatctcttgccatgtcctagaacagctattccttgggggaggagaaaagaaaacacgaaggcagcatcaaattatctggattttcacccaggcatggtggctcacacctgtaatcccaagttttttgggaggtgaggtgggcggaacaatcacctgaggtcaggactttgagaccagcctggccaacatgctgaaacccagtctctactaaaaatacaaaaattagcccagtgtggtgacaggcactctggtcccagctactaggaaggcaggagaatcactggaactcaggaggtggaggttgcagtgagccgagattgcaccactgtactctagcctgggcaacaagagtgaaattctgcttcaaaaaaaaaaaaagtatctggatttttccctccaagcttcatgtgcactcacccccgggcccaatttgcatcgttcttccagagcaatgcaccacccaccccagctcaccagcagtggggcagcatcactgcccgagtgagccagtgtgactgcgggagtgcacacatctactggctctgcagggacaggaacaggttgggaagcctgccctcttgctcctgccttctgcccctgcaagtccctcaccagagtatcccctctgcttcaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggtaagcacaaggccaggggccccatgactggaccagtgccaccacacatgaccgcgtacaactccgggggtgccattcctattctgattcaagacaaatctgtatattcattgtgatggttttcctgcaagttgtaatggagttgaggaaaaataggtatttttcctttctgcaacccccccaaccccccgacaaaagtggggctgcaggtgggacaggaagaggccagacccaggccagagtagagcaaattcaacagtcagctgtgccgaacactagtctctgctctggccgagcatgaggtcctttaggtgcaaatcttactgatactgtttggggacccttgctgaaggtctgaaagcactcactatatcctcatgtttctcttacagcagctctgtgtgggattcagcaaaaacatagctgcaccttataagcaggaaagtgaggaatatagaaagagagactaatcaaggccatatggtgaatcaggaaagaagttcgagccttgttttctgattcccaggttaacacagtaaactggaggtaaacaagtaataaagtcttattagattcacacctataaaaagatgtttggctatgggactgtcaggagagaaggggtatagagacagcatgaaatggagcctgctgcactttctttaaggctctgctcctcctgacaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtgagatttggggggaccggaaaggagaagttcaggtacaagctcataatcccacttgaggagaaagagtgaattataactgtacagttgatattccggttttggtattctttctgaccctggctctaactccttacctgatgtctggtctatcacagtcaacttactagcactgggtctgtttctcatgccaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 2 - DNA, 6641 bp, homo sapien
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcaggtaaggagaccagtcccctgagggagcgtggagtgcctccccatctacagcactgcttctacatatcctggtcatcagaaccactactggggcctcttttgtgggtacactttccctttagtaaaggcttatgcagtatttcctttgacttctaatgctatgtaagtttacctaacaccttcacgggtctcttttatccacacagtgtttcagcctaccatcttggagtgctgagatactacatggtttgcccaaagtcacccagcaagtcttagaagcagggttcaagtcttcctgattggtgtagctctgctacttcctcaccaagagctgacaggctatatctcaagaaattccaaggaagcaccaaactgtaacagctgttcctctggaagcaaagttttgccagaaacagttctctggtgttcctaagatttaccaggaatgagcattaatggaattttgtgtcctctctctgtaaacgtaactcttctcattggctcagagttaagtgtagagacacataaccatgtgaagagtccctttgtgttcaggaaggatgcggctccttaaggttcctcaattgtgatacgtctatttttttccatggtcttaaatgaatttctccgaatacaggattttttaaatgcaatgctgaaatatagacttaataggccaaaaataagataaatttaatctttcttttgcaaaataacttttatttctggttagctcagctcaggtgggccaacatgaatttacggtttagagataaaaatttggttttctgaaattatcaggaaaatattagttgtaaggagcatatcctatagacatgtcatttcttgctgatataaaaaccattggtcccattataaactacatgaagaacaaagacatgatcagcttctactgactaagtcaatggttaacctcagctcaaattaagaaaaagttttaacatgaaaccaagcttgaaaattctgttacctgaaccaacatgtatcaatcactttctaagcatggacttccgggccctcagtttgggattagaaaggtattctcaggccattttccagacaagtgagtcctgatttggtctgtgagatgaaaccagacatgcggaagaccaggccagacagaggaatctgaccgtgccacttcctgctcatccaaacaggaggctttctcaccatcctgcaaggaggttcttggggtcaagtgcagctctcccaccaggtctcttgctcttcttgcccaggacatcattccttatttttcttctctatgaccaagtgctcagttacccttatattctataagtaggtagtcccttagaggaagcagtaagttggtgctttcaccactaagacgaaatgaagaatagtgatggcgaaggcacacgtactctacctccctttcccaaggtgctctgcaagagaacctatgtgcctcagacaactcccatctgccatcttggtgctcctctctaaggtcccagtgcagtggtcaccaagaaaagcaccccgagacatagcaggcaggaagcttctcttggatagtaagggccgcagtctctgaatcctatcagaaaaggctgtctcttccactatgctctttgatatttagaatacagagcttaaatcctgcataaagtagcagctccatggccctagagtaaaaaaactggccagtctgatgctctcatttcattgttttaacaaaacttctgggaggaaggcctcaaaggttcttctgagtgttttgaggtgctagctggatggaaggggaaaatatgtgataataaaatctatctcccttaattatggtctcaggtggcagtagccaccatctctgaacaacaacaaaaacaaccaaccaggaaacatcaacaaaaccagactctatgagatattcacgactgatttgttatagtggcggctgtctaagaagtctgaatctatctgacaggagtatctgttacgtggccctcatacactgtaacatttctagaattcatggcccagctatagcagaataatttatttcagagttaacctgaaaccacctgttggaacgtcccactaatgctatccaggtgaagggcttccctacccctctgctccaccgctagtaaagccaaaatacaccccctctggatctccccatatccacctctcccaaatgcagacactgatgggtaattaacaccactgagaatcccagggtagaaataaaggctcagtctctaaacactcaactcagatggagccactgggtctaaatgctcaccctgtggtttgttctcttgtagatgccatctacgactgctcttccctctaccagaagaactaccgcatctctggagtgtataagcttcctcctgatgacttcctgggcagccctgaactggaggtgaggtcattacagtcactggccatgccctaatacctgtccttcaccccctcaaggggactacaacaacagggccattcacagtttaaagaaaggaaaattcggctgggcgcagtggctcacacctgtaatcccagcactatgggaggccgaggcaggtggatcacttcaggtcaggagtttaagaccagcctggccaacatggtgaaaccctgtctctactaaaaatacaaaaaaattagccaggcatggtggtgggcacctgtaatccctgctacacaggaggattgcttgaactcaggaggcagaggttgcagtgagccgagatcacgccactgcactataatctgggagacaaagtgagactccatttcaattaaaaaaaaaaaaaaaaaaaaggaaaactcaaacacaagcaaacacaccaaacaccacagagctatgcaaacactcagtttatgccctgcactccaaacccaggcatctgtttggccccttcaaatcattatcagtcaaacaacaagccttctaacatagatcagatcattcttataaccaccacataacttagtttaaatctcttgccatgtcctagaacagctattccttgggggaggagaaaagaaaacacgaaggcagcatcaaattatctggattttcacccaggcatggtggctcacacctgtaatcccaagttttttgggaggtgaggtgggcggaacaatcacctgaggtcaggactttgagaccagcctggccaacatgctgaaacccagtctctactaaaaatacaaaaattagcccagtgtggtgacaggcactctggtcccagctactaggaaggcaggagaatcactggaactcaggaggtggaggttgcagtgagccgagattgcaccactgtactctagcctgggcaacaagagtgaaattctgcttcaaaaaaaaaaaaagtatctggatttttccctccaagcttcatgtgcactcacccccgggcccaatttgcatcgttcttccagagcaatgcaccacccaccccagctcaccagcagtggggcagcatcactgcccgagtgagccagtgtgactgcgggagtgcacacatctactggctctgcagggacaggaacaggttgggaagcctgccctcttgctcctgccttctgcccctgcaagtccctcaccagagtatcccctctgcttcaggtgttctgtgacatggagacttcaggcggaggctggaccatcatccagagatgaaaaagtggccttgtctccttctaccgggactggaagcagtacaagcagggctttggcagcatccgtggggacttctggctggggaacgaacacatccaccggctctccagacagccaacccggctgcgtgtagagatggaggtaagcacaaggccaggggccccatgactggaccagtgccaccacacatgaccgcgtacaactccgggggtgccattcctattctgattcaagacaaatctgtatattcattgtgatggttttcctgcaagttgtaatggagttgaggaaaaataggtatttttcctttctgcaacccccccaaccccccgacaaaagtggggctgcaggtgggacaggaagaggccagacccaggccagagtagagcaaattcaacagtcagctgtgccgaacactagtctctgctctggccgagcatgaggtcctttaggtgcaaatcttactgatactgtttggggacccttgctgaaggtctgaaagcactcactatatcctcatgtttctcttacagcagctctgtgtgggattcagcaaaaacatagctgcaccttataagcaggaaagtgaggaatatagaaagagagactaatcaaggccatatggtgaatcaggaaagaagttcgagccttgttttctgattcccaggttaacacagtaaactggaggtaaacaagtaataaagtcttattagattcacacctataaaaagatgtttggctatgggactgtcaggagagaaggggtatagagacagcatgaaatggagcctgctgcactttctttaaggctctgctcctcctgacaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtgagatttggggggaccggaaaggagaagttcaggtacaagctcataatcccacttgaggagaaagagtgaattataactgtacagttgatattccggttttggtattctttctgaccctggctctaactccttacctgatgtctggtctatcacagtcaacttactagcactgggtctgtttctcatgccaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 3 - DNA, 6641 bp, homo sapien
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcaggtaaggagaccagtcccctgagggagcgtggagtgcctccccatctacagcactgcttctacatatcctggtcatcagaaccactactggggcctcttttgtgggtacactttccctttagtaaaggcttatgcagtatttcctttgacttctaatgctatgtaagtttacctaacaccttcacgggtctcttttatccacacagtgtttcagcctaccatcttggagtgctgagatactacatggtttgcccaaagtcacccagcaagtcttagaagcagggttcaagtcttcctgattggtgtagctctgctacttcctcaccaagagctgacaggctatatctcaagaaattccaaggaagcaccaaactgtaacagctgttcctctggaagcaaagttttgccagaaacagttctctggtgttcctaagatttaccaggaatgagcattaatggaattttgtgtcctctctctgtaaacgtaactcttctcattggctcagagttaagtgtagagacacataaccatgtgaagagtccctttgtgttcaggaaggatgcggctccttaaggttcctcaattgtgatacgtctatttttttccatggtcttaaatgaatttctccgaatacaggattttttaaatgcaatgctgaaatatagacttaataggccaaaaataagataaatttaatctttcttttgcaaaataacttttatttctggttagctcagctcaggtgggccaacatgaatttacggtttagagataaaaatttggttttctgaaattatcaggaaaatattagttgtaaggagcatatcctatagacatgtcatttcttgctgatataaaaaccattggtcccattataaactacatgaagaacaaagacatgatcagcttctactgactaagtcaatggttaacctcagctcaaattaagaaaaagttttaacatgaaaccaagcttgaaaattctgttacctgaaccaacatgtatcaatcactttctaagcatggacttccgggccctcagtttgggattagaaaggtattctcaggccattttccagacaagtgagtcctgatttggtctgtgagatgaaaccagacatgcggaagaccaggccagacagaggaatctgaccgtgccacttcctgctcatccaaacaggaggctttctcaccatcctgcaaggaggttcttggggtcaagtgcagctctcccaccaggtctcttgctcttcttgcccaggacatcattccttatttttcttctctatgaccaagtgctcagttacccttatattctataagtaggtagtcccttagaggaagcagtaagttggtgctttcaccactaagacgaaatgaagaatagtgatggcgaaggcacacgtactctacctccctttcccaaggtgctctgcaagagaacctatgtgcctcagacaactcccatctgccatcttggtgctcctctctaaggtcccagtgcagtggtcaccaagaaaagcaccccgagacatagcaggcaggaagcttctcttggatagtaagggccgcagtctctgaatcctatcagaaaaggctgtctcttccactatgctctttgatatttagaatacagagcttaaatcctgcataaagtagcagctccatggccctagagtaaaaaaactggccagtctgatgctctcatttcattgttttaacaaaacttctgggaggaaggcctcaaaggttcttctgagtgttttgaggtgctagctggatggaaggggaaaatatgtgataataaaatctatctcccttaattatggtctcaggtggcagtagccaccatctctgaacaacaacaaaaacaaccaaccaggaaacatcaacaaaaccagactctatgagatattcacgactgatttgttatagtggcggctgtctaagaagtctgaatctatctgacaggagtatctgttacgtggccctcatacactgtaacatttctagaattcatggcccagctatagcagaataatttatttcagagttaacctgaaaccacctgttggaacgtcccactaatgctatccaggtgaagggcttccctacccctctgctccaccgctagtaaagccaaaatacaccccctctggatctccccatatccacctctcccaaatgcagacactgatgggtaattaacaccactgagaatcccagggtagaaataaaggctcagtctctaaacactcaactcagatggagccactgggtctaaatgctcaccctgtggtttgttctcttgtagatgccatctacgactgctcttccctctaccagaagaactaccgcatctctggagtgtataagcttcctcctgatgacttcctgggcagccctgaactggaggtgaggtcattacagtcactggccatgccctaatacctgtccttcaccccctcaaggggactacaacaacagggccattcacagtttaaagaaaggaaaattcggctgggcgcagtggctcacacctgtaatcccagcactatgggaggccgaggcaggtggatcacttcaggtcaggagtttaagaccagcctggccaacatggtgaaaccctgtctctactaaaaatacaaaaaaattagccaggcatggtggtgggcacctgtaatccctgctacacaggaggattgcttgaactcaggaggcagaggttgcagtgagccgagatcacgccactgcactataatctgggagacaaagtgagactccatttcaattaaaaaaaaaaaaaaaaaaaaggaaaactcaaacacaagcaaacacaccaaacaccacagagctatgcaaacactcagtttatgccctgcactccaaacccaggcatctgtttggccccttcaaatcattatcagtcaaacaacaagccttctaacatagatcagatcattcttataaccaccacataacttagtttaaatctcttgccatgtcctagaacagctattccttgggggaggagaaaagaaaacacgaaggcagcatcaaattatctggattttcacccaggcatggtggctcacacctgtaatcccaagttttttgggaggtgaggtgggcggaacaatcacctgaggtcaggactttgagaccagcctggccaacatgctgaaacccagtctctactaaaaatacaaaaattagcccagtgtggtgacaggcactctggtcccagctactaggaaggcaggagaatcactggaactcaggaggtggaggttgcagtgagccgagattgcaccactgtactctagcctgggcaacaagagtgaaattctgcttcaaaaaaaaaaaaagtatctggatttttccctccaagcttcatgtgcactcacccccgggcccaatttgcatcgttcttccagagcaatgcaccacccaccccagctcaccagcagtggggcagcatcactgcccgagtgagccagtgtgactgcgggagtgcacacatctactggctctgcagggacaggaacaggttgggaagcctgccctcttgctcctgccttctgcccctgcaagtccctcaccagagtatcccctctgcttcaggtgttctgtgacatggagacttcaggcggaggctggaccatcatccatagacgaaaaagtggccttgtctccttctaccgggactggaagcagtacaagcagggctttggcagcatccgtggggacttctggctggggaacgaacacatccaccggctctccagacagccaacccggctgcgtgtagagatggaggtaagcacaaggccaggggccccatgactggaccagtgccaccacacatgaccgcgtacaactccgggggtgccattcctattctgattcaagacaaatctgtatattcattgtgatggttttcctgcaagttgtaatggagttgaggaaaaataggtatttttcctttctgcaacccccccaaccccccgacaaaagtggggctgcaggtgggacaggaagaggccagacccaggccagagtagagcaaattcaacagtcagctgtgccgaacactagtctctgctctggccgagcatgaggtcctttaggtgcaaatcttactgatactgtttggggacccttgctgaaggtctgaaagcactcactatatcctcatgtttctcttacagcagctctgtgtgggattcagcaaaaacatagctgcaccttataagcaggaaagtgaggaatatagaaagagagactaatcaaggccatatggtgaatcaggaaagaagttcgagccttgttttctgattcccaggttaacacagtaaactggaggtaaacaagtaataaagtcttattagattcacacctataaaaagatgtttggctatgggactgtcaggagagaaggggtatagagacagcatgaaatggagcctgctgcactttctttaaggctctgctcctcctgacaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtgagatttggggggaccggaaaggagaagttcaggtacaagctcataatcccacttgaggagaaagagtgaattataactgtacagttgatattccggttttggtattctttctgaccctggctctaactccttacctgatgtctggtctatcacagtcaacttactagcactgggtctgtttctcatgccaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 4 - DNA, 6641 bp, homo sapien
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcaggtaaggagaccagtcccctgagggagcgtggagtgcctccccatctacagcactgcttctacatatcctggtcatcagaaccactactggggcctcttttgtgggtacactttccctttagtaaaggcttatgcagtatttcctttgacttctaatgctatgtaagtttacctaacaccttcacgggtctcttttatccacacagtgtttcagcctaccatcttggagtgctgagatactacatggtttgcccaaagtcacccagcaagtcttagaagcagggttcaagtcttcctgattggtgtagctctgctacttcctcaccaagagctgacaggctatatctcaagaaattccaaggaagcaccaaactgtaacagctgttcctctggaagcaaagttttgccagaaacagttctctggtgttcctaagatttaccaggaatgagcattaatggaattttgtgtcctctctctgtaaacgtaactcttctcattggctcagagttaagtgtagagacacataaccatgtgaagagtccctttgtgttcaggaaggatgcggctccttaaggttcctcaattgtgatacgtctatttttttccatggtcttaaatgaatttctccgaatacaggattttttaaatgcaatgctgaaatatagacttaataggccaaaaataagataaatttaatctttcttttgcaaaataacttttatttctggttagctcagctcaggtgggccaacatgaatttacggtttagagataaaaatttggttttctgaaattatcaggaaaatattagttgtaaggagcatatcctatagacatgtcatttcttgctgatataaaaaccattggtcccattataaactacatgaagaacaaagacatgatcagcttctactgactaagtcaatggttaacctcagctcaaattaagaaaaagttttaacatgaaaccaagcttgaaaattctgttacctgaaccaacatgtatcaatcactttctaagcatggacttccgggccctcagtttgggattagaaaggtattctcaggccattttccagacaagtgagtcctgatttggtctgtgagatgaaaccagacatgcggaagaccaggccagacagaggaatctgaccgtgccacttcctgctcatccaaacaggaggctttctcaccatcctgcaaggaggttcttggggtcaagtgcagctctcccaccaggtctcttgctcttcttgcccaggacatcattccttatttttcttctctatgaccaagtgctcagttacccttatattctataagtaggtagtcccttagaggaagcagtaagttggtgctttcaccactaagacgaaatgaagaatagtgatggcgaaggcacacgtactctacctccctttcccaaggtgctctgcaagagaacctatgtgcctcagacaactcccatctgccatcttggtgctcctctctaaggtcccagtgcagtggtcaccaagaaaagcaccccgagacatagcaggcaggaagcttctcttggatagtaagggccgcagtctctgaatcctatcagaaaaggctgtctcttccactatgctctttgatatttagaatacagagcttaaatcctgcataaagtagcagctccatggccctagagtaaaaaaactggccagtctgatgctctcatttcattgttttaacaaaacttctgggaggaaggcctcaaaggttcttctgagtgttttgaggtgctagctggatggaaggggaaaatatgtgataataaaatctatctcccttaattatggtctcaggtggcagtagccaccatctctgaacaacaacaaaaacaaccaaccaggaaacatcaacaaaaccagactctatgagatattcacgactgatttgttatagtggcggctgtctaagaagtctgaatctatctgacaggagtatctgttacgtggccctcatacactgtaacatttctagaattcatggcccagctatagcagaataatttatttcagagttaacctgaaaccacctgttggaacgtcccactaatgctatccaggtgaagggcttccctacccctctgctccaccgctagtaaagccaaaatacaccccctctggatctccccatatccacctctcccaaatgcagacactgatgggtaattaacaccactgagaatcccagggtagaaataaaggctcagtctctaaacactcaactcagatggagccactgggtctaaatgctcaccctgtggtttgttctcttgtagatgccatctacgactgctcttccctctaccagaagaactaccgcatctctggagtgtataagcttcctcctgatgacttcctgggcagccctgaactggaggtgaggtcattacagtcactggccatgccctaatacctgtccttcaccccctcaaggggactacaacaacagggccattcacagtttaaagaaaggaaaattcggctgggcgcagtggctcacacctgtaatcccagcactatgggaggccgaggcaggtggatcacttcaggtcaggagtttaagaccagcctggccaacatggtgaaaccctgtctctactaaaaatacaaaaaaattagccaggcatggtggtgggcacctgtaatccctgctacacaggaggattgcttgaactcaggaggcagaggttgcagtgagccgagatcacgccactgcactataatctgggagacaaagtgagactccatttcaattaaaaaaaaaaaaaaaaaaaaggaaaactcaaacacaagcaaacacaccaaacaccacagagctatgcaaacactcagtttatgccctgcactccaaacccaggcatctgtttggccccttcaaatcattatcagtcaaacaacaagccttctaacatagatcagatcattcttataaccaccacataacttagtttaaatctcttgccatgtcctagaacagctattccttgggggaggagaaaagaaaacacgaaggcagcatcaaattatctggattttcacccaggcatggtggctcacacctgtaatcccaagttttttgggaggtgaggtgggcggaacaatcacctgaggtcaggactttgagaccagcctggccaacatgctgaaacccagtctctactaaaaatacaaaaattagcccagtgtggtgacaggcactctggtcccagctactaggaaggcaggagaatcactggaactcaggaggtggaggttgcagtgagccgagattgcaccactgtactctagcctgggcaacaagagtgaaattctgcttcaaaaaaaaaaaaagtatctggatttttccctccaagcttcatgtgcactcacccccgggcccaatttgcatcgttcttccagagcaatgcaccacccaccccagctcaccagcagtggggcagcatcactgcccgagtgagccagtgtgactgcgggagtgcacacatctactggctctgcagggacaggaacaggttgggaagcctgccctcttgctcctgccttctgcccctgcaagtccctcaccagagtatcccctctgcttcaggtgatctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggtaagcacaaggccaggggccccatgactggaccagtgccaccacacatgaccgcgtacaactccgggggtgccattcctattctgattcaagacaaatctgtatattcattgtgatggttttcctgcaagttgtaatggagttgaggaaaaataggtatttttcctttctgcaacccccccaaccccccgacaaaagtggggctgcaggtgggacaggaagaggccagacccaggccagagtagagcaaattcaacagtcagctgtgccgaacactagtctctgctctggccgagcatgaggtcctttaggtgcaaatcttactgatactgtttggggacccttgctgaaggtctgaaagcactcactatatcctcatgtttctcttacagcagctctgtgtgggattcagcaaaaacatagctgcaccttataagcaggaaagtgaggaatatagaaagagagactaatcaaggccatatggtgaatcaggaaagaagttcgagccttgttttctgattcccaggttaacacagtaaactggaggtaaacaagtaataaagtcttattagattcacacctataaaaagatgtttggctatgggactgtcaggagagaaggggtatagagacagcatgaaatggagcctgctgcactttctttaaggctctgctcctcctgacaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtgagatttggggggaccggaaaggagaagttcaggtacaagctcataatcccacttgaggagaaagagtgaattataactgtacagttgatattccggttttggtattctttctgaccctggctctaactccttacctgatgtctggtctatcacagtcaacttactagcactgggtctgtttctcatgccaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 5 - DNA, 6641 bp, homo sapien
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcaggtaaggagaccagtcccctgagggagcgtggagtgcctccccatctacagcactgcttctacatatcctggtcatcagaaccactactggggcctcttttgtgggtacactttccctttagtaaaggcttatgcagtatttcctttgacttctaatgctatgtaagtttacctaacaccttcacgggtctcttttatccacacagtgtttcagcctaccatcttggagtgctgagatactacatggtttgcccaaagtcacccagcaagtcttagaagcagggttcaagtcttcctgattggtgtagctctgctacttcctcaccaagagctgacaggctatatctcaagaaattccaaggaagcaccaaactgtaacagctgttcctctggaagcaaagttttgccagaaacagttctctggtgttcctaagatttaccaggaatgagcattaatggaattttgtgtcctctctctgtaaacgtaactcttctcattggctcagagttaagtgtagagacacataaccatgtgaagagtccctttgtgttcaggaaggatgcggctccttaaggttcctcaattgtgatacgtctatttttttccatggtcttaaatgaatttctccgaatacaggattttttaaatgcaatgctgaaatatagacttaataggccaaaaataagataaatttaatctttcttttgcaaaataacttttatttctggttagctcagctcaggtgggccaacatgaatttacggtttagagataaaaatttggttttctgaaattatcaggaaaatattagttgtaaggagcatatcctatagacatgtcatttcttgctgatataaaaaccattggtcccattataaactacatgaagaacaaagacatgatcagcttctactgactaagtcaatggttaacctcagctcaaattaagaaaaagttttaacatgaaaccaagcttgaaaattctgttacctgaaccaacatgtatcaatcactttctaagcatggacttccgggccctcagtttgggattagaaaggtattctcaggccattttccagacaagtgagtcctgatttggtctgtgagatgaaaccagacatgcggaagaccaggccagacagaggaatctgaccgtgccacttcctgctcatccaaacaggaggctttctcaccatcctgcaaggaggttcttggggtcaagtgcagctctcccaccaggtctcttgctcttcttgcccaggacatcattccttatttttcttctctatgaccaagtgctcagttacccttatattctataagtaggtagtcccttagaggaagcagtaagttggtgctttcaccactaagacgaaatgaagaatagtgatggcgaaggcacacgtactctacctccctttcccaaggtgctctgcaagagaacctatgtgcctcagacaactcccatctgccatcttggtgctcctctctaaggtcccagtgcagtggtcaccaagaaaagcaccccgagacatagcaggcaggaagcttctcttggatagtaagggccgcagtctctgaatcctatcagaaaaggctgtctcttccactatgctctttgatatttagaatacagagcttaaatcctgcataaagtagcagctccatggccctagagtaaaaaaactggccagtctgatgctctcatttcattgttttaacaaaacttctgggaggaaggcctcaaaggttcttctgagtgttttgaggtgctagctggatggaaggggaaaatatgtgataataaaatctatctcccttaattatggtctcaggtggcagtagccaccatctctgaacaacaacaaaaacaaccaaccaggaaacatcaacaaaaccagactctatgagatattcacgactgatttgttatagtggcggctgtctaagaagtctgaatctatctgacaggagtatctgttacgtggccctcatacactgtaacatttctagaattcatggcccagctatagcagaataatttatttcagagttaacctgaaaccacctgttggaacgtcccactaatgctatccaggtgaagggcttccctacccctctgctccaccgctagtaaagccaaaatacaccccctctggatctccccatatccacctctcccaaatgcagacactgatgggtaattaacaccactgagaatcccagggtagaaataaaggctcagtctctaaacactcaactcagatggagccactgggtctaaatgctcaccctgtggtttgttctcttgtagatgccatctacgactgctcttccctctaccagaagaactaccgcatctctggagtgtataagcttcctcctgatgacttcctgggcagccctgaactggaggtgaggtcattacagtcactggccatgccctaatacctgtccttcaccccctcaaggggactacaacaacagggccattcacagtttaaagaaaggaaaattcggctgggcgcagtggctcacacctgtaatcccagcactatgggaggccgaggcaggtggatcacttcaggtcaggagtttaagaccagcctggccaacatggtgaaaccctgtctctactaaaaatacaaaaaaattagccaggcatggtggtgggcacctgtaatccctgctacacaggaggattgcttgaactcaggaggcagaggttgcagtgagccgagatcacgccactgcactataatctgggagacaaagtgagactccatttcaattaaaaaaaaaaaaaaaaaaaaggaaaactcaaacacaagcaaacacaccaaacaccacagagctatgcaaacactcagtttatgccctgcactccaaacccaggcatctgtttggccccttcaaatcattatcagtcaaacaacaagccttctaacatagatcagatcattcttataaccaccacataacttagtttaaatctcttgccatgtcctagaacagctattccttgggggaggagaaaagaaaacacgaaggcagcatcaaattatctggattttcacccaggcatggtggctcacacctgtaatcccaagttttttgggaggtgaggtgggcggaacaatcacctgaggtcaggactttgagaccagcctggccaacatgctgaaacccagtctctactaaaaatacaaaaattagcccagtgtggtgacaggcactctggtcccagctactaggaaggcaggagaatcactggaactcaggaggtggaggttgcagtgagccgagattgcaccactgtactctagcctgggcaacaagagtgaaattctgcttcaaaaaaaaaaaaagtatctggatttttccctccaagcttcatgtgcactcacccccgggcccaatttgcatcgttcttccagagcaatgcaccacccaccccagctcaccagcagtggggcagcatcactgcccgagtgagccagtgtgactgcgggagtgcacacatctactggctctgcagggacaggaacaggttgggaagcctgccctcttgctcctgccttctgcccctgcaagtccctcaccagagtatcccctctgcttcaggtgttctgtgacatggagacttcaggcggaggctggaccatcatccagagacgaaaaagtggccttgtctccttctaccgggactagaagcagtacaagcagggctttggcagcatccgtggggacttctggctggggaacgaacacatccaccggctctccagacagccaacccggctgcgtgtagagatggaggtaagcacaaggccaggggccccatgactggaccagtgccaccacacatgaccgcgtacaactccgggggtgccattcctattctgattcaagacaaatctgtatattcattgtgatggttttcctgcaagttgtaatggagttgaggaaaaataggtatttttcctttctgcaacccccccaaccccccgacaaaagtggggctgcaggtgggacaggaagaggccagacccaggccagagtagagcaaattcaacagtcagctgtgccgaacactagtctctgctctggccgagcatgaggtcctttaggtgcaaatcttactgatactgtttggggacccttgctgaaggtctgaaagcactcactatatcctcatgtttctcttacagcagctctgtgtgggattcagcaaaaacatagctgcaccttataagcaggaaagtgaggaatatagaaagagagactaatcaaggccatatggtgaatcaggaaagaagttcgagccttgttttctgattcccaggttaacacagtaaactggaggtaaacaagtaataaagtcttattagattcacacctataaaaagatgtttggctatgggactgtcaggagagaaggggtatagagacagcatgaaatggagcctgctgcactttctttaaggctctgctcctcctgacaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtgagatttggggggaccggaaaggagaagttcaggtacaagctcataatcccacttgaggagaaagagtgaattataactgtacagttgatattccggttttggtattctttctgaccctggctctaactccttacctgatgtctggtctatcacagtcaacttactagcactgggtctgtttctcatgccaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 6 - DNA, 6641 bp, homo sapien
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcaggtaaggagaccagtcccctgagggagcgtggagtgcctccccatctacagcactgcttctacatatcctggtcatcagaaccactactggggcctcttttgtgggtacactttccctttagtaaaggcttatgcagtatttcctttgacttctaatgctatgtaagtttacctaacaccttcacgggtctcttttatccacacagtgtttcagcctaccatcttggagtgctgagatactacatggtttgcccaaagtcacccagcaagtcttagaagcagggttcaagtcttcctgattggtgtagctctgctacttcctcaccaagagctgacaggctatatctcaagaaattccaaggaagcaccaaactgtaacagctgttcctctggaagcaaagttttgccagaaacagttctctggtgttcctaagatttaccaggaatgagcattaatggaattttgtgtcctctctctgtaaacgtaactcttctcattggctcagagttaagtgtagagacacataaccatgtgaagagtccctttgtgttcaggaaggatgcggctccttaaggttcctcaattgtgatacgtctatttttttccatggtcttaaatgaatttctccgaatacaggattttttaaatgcaatgctgaaatatagacttaataggccaaaaataagataaatttaatctttcttttgcaaaataacttttatttctggttagctcagctcaggtgggccaacatgaatttacggtttagagataaaaatttggttttctgaaattatcaggaaaatattagttgtaaggagcatatcctatagacatgtcatttcttgctgatataaaaaccattggtcccattataaactacatgaagaacaaagacatgatcagcttctactgactaagtcaatggttaacctcagctcaaattaagaaaaagttttaacatgaaaccaagcttgaaaattctgttacctgaaccaacatgtatcaatcactttctaagcatggacttccgggccctcagtttgggattagaaaggtattctcaggccattttccagacaagtgagtcctgatttggtctgtgagatgaaaccagacatgcggaagaccaggccagacagaggaatctgaccgtgccacttcctgctcatccaaacaggaggctttctcaccatcctgcaaggaggttcttggggtcaagtgcagctctcccaccaggtctcttgctcttcttgcccaggacatcattccttatttttcttctctatgaccaagtgctcagttacccttatattctataagtaggtagtcccttagaggaagcagtaagttggtgctttcaccactaagacgaaatgaagaatagtgatggcgaaggcacacgtactctacctccctttcccaaggtgctctgcaagagaacctatgtgcctcagacaactcccatctgccatcttggtgctcctctctaaggtcccagtgcagtggtcaccaagaaaagcaccccgagacatagcaggcaggaagcttctcttggatagtaagggccgcagtctctgaatcctatcagaaaaggctgtctcttccactatgctctttgatatttagaatacagagcttaaatcctgcataaagtagcagctccatggccctagagtaaaaaaactggccagtctgatgctctcatttcattgttttaacaaaacttctgggaggaaggcctcaaaggttcttctgagtgttttgaggtgctagctggatggaaggggaaaatatgtgataataaaatctatctcccttaattatggtctcaggtggcagtagccaccatctctgaacaacaacaaaaacaaccaaccaggaaacatcaacaaaaccagactctatgagatattcacgactgatttgttatagtggcggctgtctaagaagtctgaatctatctgacaggagtatctgttacgtggccctcatacactgtaacatttctagaattcatggcccagctatagcagaataatttatttcagagttaacctgaaaccacctgttggaacgtcccactaatgctatccaggtgaagggcttccctacccctctgctccaccgctagtaaagccaaaatacaccccctctggatctccccatatccacctctcccaaatgcagacactgatgggtaattaacaccactgagaatcccagggtagaaataaaggctcagtctctaaacactcaactcagatggagccactgggtctaaatgctcaccctgtggtttgttctcttgtagatgccatctacgactgctcttccctctaccagaagaactaccgcatctctggagtgtataagcttcctcctgatgacttcctgggcagccctgaactggaggtgaggtcattacagtcactggccatgccctaatacctgtccttcaccccctcaaggggactacaacaacagggccattcacagtttaaagaaaggaaaattcggctgggcgcagtggctcacacctgtaatcccagcactatgggaggccgaggcaggtggatcacttcaggtcaggagtttaagaccagcctggccaacatggtgaaaccctgtctctactaaaaatacaaaaaaattagccaggcatggtggtgggcacctgtaatccctgctacacaggaggattgcttgaactcaggaggcagaggttgcagtgagccgagatcacgccactgcactataatctgggagacaaagtgagactccatttcaattaaaaaaaaaaaaaaaaaaaaggaaaactcaaacacaagcaaacacaccaaacaccacagagctatgcaaacactcagtttatgccctgcactccaaacccaggcatctgtttggccccttcaaatcattatcagtcaaacaacaagccttctaacatagatcagatcattcttataaccaccacataacttagtttaaatctcttgccatgtcctagaacagctattccttgggggaggagaaaagaaaacacgaaggcagcatcaaattatctggattttcacccaggcatggtggctcacacctgtaatcccaagttttttgggaggtgaggtgggcggaacaatcacctgaggtcaggactttgagaccagcctggccaacatgctgaaacccagtctctactaaaaatacaaaaattagcccagtgtggtgacaggcactctggtcccagctactaggaaggcaggagaatcactggaactcaggaggtggaggttgcagtgagccgagattgcaccactgtactctagcctgggcaacaagagtgaaattctgcttcaaaaaaaaaaaaagtatctggatttttccctccaagcttcatgtgcactcacccccgggcccaatttgcatcgttcttccagagcaatgcaccacccaccccagctcaccagcagtggggcagcatcactgcccgagtgagccagtgtgactgcgggagtgcacacatctactggctctgcagggacaggaacaggttgggaagcctgccctcttgctcctgccttctgcccctgcaagtccctcaccagagtatcccctctgcttcaggtgttctgtgacatggagacttcaggcggaggctggaccatcatccagagacgaaaaagtggccttgtctccttctaccgggactggaagcagtaccagcagggctttggcagcatccgtggggacttctggctggggaacgaacacatccaccggctctccagacagccaacccggctgcgtgtagagatggaggtaagcacaaggccaggggccccatgactggaccagtgccaccacacatgaccgcgtacaactccgggggtgccattcctattctgattcaagacaaatctgtatattcattgtgatggttttcctgcaagttgtaatggagttgaggaaaaataggtatttttcctttctgcaacccccccaaccccccgacaaaagtggggctgcaggtgggacaggaagaggccagacccaggccagagtagagcaaattcaacagtcagctgtgccgaacactagtctctgctctggccgagcatgaggtcctttaggtgcaaatcttactgatactgtttggggacccttgctgaaggtctgaaagcactcactatatcctcatgtttctcttacagcagctctgtgtgggattcagcaaaaacatagctgcaccttataagcaggaaagtgaggaatatagaaagagagactaatcaaggccatatggtgaatcaggaaagaagttcgagccttgttttctgattcccaggttaacacagtaaactggaggtaaacaagtaataaagtcttattagattcacacctataaaaagatgtttggctatgggactgtcaggagagaaggggtatagagacagcatgaaatggagcctgctgcactttctttaaggctctgctcctcctgacaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtgagatttggggggaccggaaaggagaagttcaggtacaagctcataatcccacttgaggagaaagagtgaattataactgtacagttgatattccggttttggtattctttctgaccctggctctaactccttacctgatgtctggtctatcacagtcaacttactagcactgggtctgtttctcatgccaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 7 - RNA, 1041 nt, homo sapien
augcugaaaaagccucucucagcugugaccuggcucugcauuuucaucguggccuuugucagccacccagcguggcugcagaagcucucuaagcacaagacaccagcacagccacagcucaaagcggccaacugcugugaggaggugaaggagcucaaggcccaaguugccaaccuuagcagccugcugagugaacugaacaagaagcaggagagggacugggucagcguggucaugcaggugauggagcuggagagcaacagcaagcgcauggagucgcggcucacagaugcugagagcaaguacuccgagaugaacaaccaaauugacaucaugcagcugcaggcagcacagacggucacucagaccuccgcagaugccaucuacgacugcucuucccucuaccagaagaacuaccgcaucucuggaguguauaagcuuccuccugaugacuuccugggcagcccugaacuggagguguucugugacauggagacuucaggcggaggcuggaccaucauccagagacgaaaaaguggccuugucuccuucuaccgggacuggaagcaguacaagcagggcuuuggcagcauccguggggacuucuggcuggggaacgaacacauccaccggcucuccagacagccaacccggcugcguguagagauggaggacugggagggcaaccugcgcuacgcugaguauagccacuuuguuuugggcaaugaacucaacagcuaucgccucuuccuggggaacuacacuggcaauguggggaacgacgcccuccaguaucauaacaacacagccuucagcaccaaggacaaggacaaugacaacugcuuggacaagugugcacagcuccgcaaagguggcuacugguacaacugcugcacagacuccaaccucaauggaguguacuaccgccugggugagcacaauaagcaccuggauggcaucaccugguauggcuggcauggaucuaccuacucccucaaacggguggagaugaaaauccgcccagaagacuucaagccuuaa

SEQ ID NO: 8 - RNA, 531 nt, homo sapien
augcugaaaaagccucucucagcugugaccuggcucugcauuuucaucguggccuuugucagccacccagcguggcugcagaagcucucuaagcacaagacaccagcacagccacagcucaaagcggccaacugcugugaggaggugaaggagcucaaggcccaaguugccaaccuuagcagccugcugagugaacugaacaagaagcaggagagggacugggucagcguggucaugcaggugauggagcuggagagcaacagcaagcgcauggagucgcggcucacagaugcugagagcaaguacuccgagaugaacaaccaaauugacaucaugcagcugcaggcagcacagacggucacucagaccuccgcagaugccaucuacgacugcucuucccucuaccagaagaacuaccgcaucucuggaguguauaagcuuccuccugaugacuuccugggcagcccugaacuggagguguucugugacauggagacuucaggcggaggcuggaccaucauccagagauga

SEQ ID NO: 9 - RNA, 1041 nt, homo sapien
augcugaaaaagccucucucagcugugaccuggcucugcauuuucaucguggccuuugucagccacccagcguggcugcagaagcucucuaagcacaagacaccagcacagccacagcucaaagcggccaacugcugugaggaggugaaggagcucaaggcccaaguugccaaccuuagcagccugcugagugaacugaacaagaagcaggagagggacugggucagcguggucaugcaggugauggagcuggagagcaacagcaagcgcauggagucgcggcucacagaugcugagagcaaguacuccgagaugaacaaccaaauugacaucaugcagcugcaggcagcacagacggucacucagaccuccgcagaugccaucuacgacugcucuucccucuaccagaagaacuaccgcaucucuggaguguauaagcuuccuccugaugacuuccugggcagcccugaacuggagguguucugugacauggagacuucaggcggaggcuggaccaucauccauagacgaaaaaguggccuugucuccuucuaccgggacuggaagcaguacaagcagggcuuuggcagcauccguggggacuucuggcuggggaacgaacacauccaccggcucuccagacagccaacccggcugcguguagagauggaggacugggagggcaaccugcgcuacgcugaguauagccacuuuguuuugggcaaugaacucaacagcuaucgccucuuccuggggaacuacacuggcaauguggggaacgacgcccuccaguaucauaacaacacagccuucagcaccaaggacaaggacaaugacaacugcuuggacaagugugcacagcuccgcaaagguggcuacugguacaacugcugcacagacuccaaccucaauggaguguacuaccgccugggugagcacaauaagcaccuggauggcaucaccugguauggcuggcauggaucuaccuacucccucaaacggguggagaugaaaauccgcccagaagacuucaagccuuaa

SEQ ID NO: 10 - RNA, 1041 nt, homo sapien
augcugaaaaagccucucucagcugugaccuggcucugcauuuucaucguggccuuugucagccacccagcguggcugcagaagcucucuaagcacaagacaccagcacagccacagcucaaagcggccaacugcugugaggaggugaaggagcucaaggcccaaguugccaaccuuagcagccugcugagugaacugaacaagaagcaggagagggacugggucagcguggucaugcaggugauggagcuggagagcaacagcaagcgcauggagucgcggcucacagaugcugagagcaaguacuccgagaugaacaaccaaauugacaucaugcagcugcaggcagcacagacggucacucagaccuccgcagaugccaucuacgacugcucuucccucuaccagaagaacuaccgcaucucuggaguguauaagcuuccuccugaugacuuccugggcagcccugaacuggaggugaucugugacauggagacuucaggcggaggcuggaccaucauccagagacgaaaaaguggccuugucuccuucuaccgggacuggaagcaguacaagcagggcuuuggcagcauccguggggacuucuggcuggggaacgaacacauccaccggcucuccagacagccaacccggcugcguguagagauggaggacugggagggcaaccugcgcuacgcugaguauagccacuuuguuuugggcaaugaacucaacagcuaucgccucuuccuggggaacuacacuggcaauguggggaacgacgcccuccaguaucauaacaacacagccuucagcaccaaggacaaggacaaugacaacugcuuggacaagugugcacagcuccgcaaagguggcuacugguacaacugcugcacagacuccaaccucaauggaguguacuaccgccugggugagcacaauaagcaccuggauggcaucaccugguauggcuggcauggaucuaccuacucccucaaacggguggagaugaaaauccgcccagaagacuucaagccuuaa

SEQ ID NO: 11 - RNA, 1041 nt, homo sapien
augcugaaaaagccucucucagcugugaccuggcucugcauuuucaucguggccuuugucagccacccagcguggcugcagaagcucucuaagcacaagacaccagcacagccacagcucaaagcggccaacugcugugaggaggugaaggagcucaaggcccaaguugccaaccuuagcagccugcugagugaacugaacaagaagcaggagagggacugggucagcguggucaugcaggugauggagcuggagagcaacagcaagcgcauggagucgcggcucacagaugcugagagcaaguacuccgagaugaacaaccaaauugacaucaugcagcugcaggcagcacagacggucacucagaccuccgcagaugccaucuacgacugcucuucccucuaccagaagaacuaccgcaucucuggaguguauaagcuuccuccugaugacuuccugggcagcccugaacuggagguguucugugacauggagacuucaggcggaggcuggaccaucauccagagacgaaaaaguggccuugucuccuucuaccgggacuagaagcaguacaagcagggcuuuggcagcauccguggggacuucuggcuggggaacgaacacauccaccggcucuccagacagccaacccggcugcguguagagauggaggacugggagggcaaccugcgcuacgcugaguauagccacuuuguuuugggcaaugaacucaacagcuaucgccucuuccuggggaacuacacuggcaauguggggaacgacgcccuccaguaucauaacaacacagccuucagcaccaaggacaaggacaaugacaacugcuuggacaagugugcacagcuccgcaaagguggcuacugguacaacugcugcacagacuccaaccucaauggaguguacuaccgccugggugagcacaauaagcaccuggauggcaucaccugguauggcuggcauggaucuaccuacucccucaaacggguggagaugaaaauccgcccagaagacuucaagccuuaa

SEQ ID NO: 12 - RNA, 1041 nt, homo sapien
augcugaaaaagccucucucagcugugaccuggcucugcauuuucaucguggccuuugucagccacccagcguggcugcagaagcucucuaagcacaagacaccagcacagccacagcucaaagcggccaacugcugugaggaggugaaggagcucaaggcccaaguugccaaccuuagcagccugcugagugaacugaacaagaagcaggagagggacugggucagcguggucaugcaggugauggagcuggagagcaacagcaagcgcauggagucgcggcucacagaugcugagagcaaguacuccgagaugaacaaccaaauugacaucaugcagcugcaggcagcacagacggucacucagaccuccgcagaugccaucuacgacugcucuucccucuaccagaagaacuaccgcaucucuggaguguauaagcuuccuccugaugacuuccugggcagcccugaacuggagguguucugugacauggagacuucaggcggaggcuggaccaucauccagagacgaaaaaguggccuugucuccuucuaccgggacuggaagcaguaccagcagggcuuuggcagcauccguggggacuucuggcuggggaacgaacacauccaccggcucuccagacagccaacccggcugcguguagagauggaggacugggagggcaaccugcgcuacgcugaguauagccacuuuguuuugggcaaugaacucaacagcuaucgccucuuccuggggaacuacacuggcaauguggggaacgacgcccuccaguaucauaacaacacagccuucagcaccaaggacaaggacaaugacaacugcuuggacaagugugcacagcuccgcaaagguggcuacugguacaacugcugcacagacuccaaccucaauggaguguacuaccgccugggugagcacaauaagcaccuggauggcaucaccugguauggcuggcauggaucuaccuacucccucaaacggguggagaugaaaauccgcccagaagacuucaagccuuaa

SEQ ID NO: 13 - DNA, 1041 bp, homo sapien
atgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaa

SEQ ID NO: 14 - DNA, 531 bp, homo sapien
atgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagatga

SEQ ID NO: 15 - DNA, 1041 bp, homo sapien
atgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccatagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaa

SEQ ID NO: 16 - DNA, 1041 bp, homo sapien
atgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgatctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaa

SEQ ID NO: 17 - DNA, 1041 bp, homo sapien
atgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactagaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaa

SEQ ID NO: 18 - DNA, 1041 bp, homo sapien
atgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactggaagcagtaccagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaa

SEQ ID NO: 19 - protein, 346 aa, homo sapien
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 20 - protein, 176 aa, homo sapien
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQR

SEQ ID NO: 21 - protein, 346 aa, homo sapien
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIHRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 22 - protein, 346 aa, homo sapien
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVICDMETSGGGWTIIQRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 23 - protein, 187 aa, homo sapien
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRD

SEQ ID NO: 24 - protein, 346 aa, homo sapien
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRDWKQYQQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 25 - DNA, 23 bp, artificial sequence
  Guide RNA Recognition Sequence
ctgcagggacaggaacaggttgg

SEQ ID NO: 26 - DNA, 23 bp, artificial sequence
  Guide RNA Recognition Sequence
cagagtatcccctctgcttcagg

SEQ ID NO: 27 - DNA, 23 bp, artificial sequence
  GGCTCTGCAGGGACAGGAACAGG
ggctctgcagggacaggaacagg

SEQ ID NO: 28 - DNA, 23 bp, artificial sequence
  Guide RNA Recognition Sequence
gcttcaggtgttctgtgacatgg

SEQ ID NO: 29 - DNA, 23 bp, artificial sequence
  Guide RNA Recognition Sequence
tgcagggacaggaacaggttggg

SEQ ID NO: 30 - DNA, 23 bp, artificial sequence
  Guide RNA Recognition Sequence
tctactggctctgcagggacagg

SEQ ID NO: 31 - DNA, 23 bp, artificial sequence
  Guide RNA Recognition Sequence
ccttctaccgggactggaagcag

SEQ ID NO: 32 - DNA, 23 bp, artificial sequence
  Guide RNA Recognition Sequence
ccgtggggacttctggctgggga

SEQ ID NO: 33 - DNA, 23 bp, artificial sequence
  Guide RNA Recognition Sequence
ccgggactggaagcagtacaagc

SEQ ID NO: 34 - DNA, 23 bp, artificial sequence
  Guide RNA Recognition Sequence
ccttgtctccttctaccgggact

SEQ ID NO: 35 - DNA, 23 bp, artificial sequence
  Guide RNA Recognition Sequence
ccaccggctctccagacagccaa

SEQ ID NO: 36 - DNA, 23 bp, artificial sequence
  Guide RNA Recognition Sequence
ccggctctccagacagccaaccc

SEQ ID NO: 37 - DNA, 23 bp, artificial sequence
  Guide RNA Recognition Sequence
tggagacttcaggcggaggctgg

SEQ ID NO: 38 - DNA, 23 bp, artificial sequence
  Guide RNA Recognition Sequence
tgtgacatggagacttcaggcgg

SEQ ID NO: 39 - DNA, 23 bp, artificial sequence
  Guide RNA Recognition Sequence
ttctgtgacatggagacttcagg

SEQ ID NO: 40 - DNA, 23 bp, artificial sequence
  Guide RNA Recognition Sequence
gacatggagacttcaggcggagg

SEQ ID NO: 41 - DNA, 23 bp, artificial sequence
  Guide RNA Recognition Sequence
ccatgactggaccagtgccacca

SEQ ID NO: 42 - DNA, 23 bp, artificial sequence
  Guide RNA Recognition Sequence
cccggctgcgtgtagagatggag

SEQ ID NO: 43 - DNA, 23 bp, artificial sequence
  Guide RNA Recognition Sequence
ccggctgcgtgtagagatggagg

SEQ ID NO: 44 - DNA, 23 bp, artificial sequence
  Guide RNA Recognition Sequence
ccaacccggctgcgtgtagagat

SEQ ID NO: 45 - DNA, 23 bp, artificial sequence
  Guide RNA Recognition Sequence
ccaggggccccatgactggacca

SEQ ID NO: 46 - DNA, 23 bp, artificial sequence
  Guide RNA Recognition Sequence
ccccatgactggaccagtgccac

SEQ ID NO: 47 - DNA, 23 bp, artificial sequence
  Guide RNA Recognition Sequence
ctgcttccagtcccggtagaagg

SEQ ID NO: 48 - DNA, 23 bp, artificial sequence
  Guide RNA Recognition Sequence
ttgtctccttctaccgggactgg

SEQ ID NO: 49 - DNA, 23 bp, artificial sequence
  Guide RNA Recognition Sequence
gcgggagtgcacacatctactgg

SEQ ID NO: 50 - DNA, 23 bp, artificial sequence
  Guide RNA Recognition Sequence
ggactggaagcagtacaagcagg

SEQ ID NO: 51 - DNA, 23 bp, artificial sequence
  Guide RNA Recognition Sequence
gtggccttgtctccttctaccgg

SEQ ID NO: 52 - DNA, 23 bp, artificial sequence
  Guide RNA Recognition Sequence
tactctggtgagggacttgcagg

SEQ ID NO: 53 - DNA, 23 bp, artificial sequence
  Guide RNA Recognition Sequence
actctggtgagggacttgcaggg

SEQ ID NO: 54 - DNA, 23 bp, artificial sequence
  Guide RNA Recognition Sequence
gcttgtactgcttccagtcccgg

SEQ ID NO: 55 - DNA, 23 bp, artificial sequence
  Guide RNA Recognition Sequence
agtcccggtagaaggagacaagg

SEQ ID NO: 56 - DNA, 23 bp, artificial sequence
  Guide RNA Recognition Sequence
cacacatctactggctctgcagg

SEQ ID NO: 57 - DNA, 23 bp, artificial sequence
  Guide RNA Recognition Sequence
caaggccactttttcgtctatgg

SEQ ID NO: 58 - DNA, 23 bp, artificial sequence
  Guide RNA Recognition Sequence
gactggaagcagtacaagcaggg

SEQ ID NO: 59 - DNA, 23 bp, artificial sequence
  Guide RNA Recognition Sequence
gcagaggggatactctggtgagg

SEQ ID NO: 60 - DNA, 23 bp, artificial sequence
  Guide RNA Recognition Sequence
ctctggtgagggacttgcagggg

SEQ ID NO: 61 - DNA, 23 bp, artificial sequence
  Guide RNA Recognition Sequence
cagaggggatactctggtgaggg

SEQ ID NO: 62 - DNA, 23 bp, artificial sequence
  Guide RNA Recognition Sequence
actttttcgtctatggatgatgg

SEQ ID NO: 63 - DNA, 23 bp, artificial sequence
  Guide RNA Recognition Sequence
tggccttgtctccttctaccggg

SEQ ID NO: 64 - DNA, 23 bp, artificial sequence
  Guide RNA Recognition Sequence
aagcagtacaagcagggctttgg

SEQ ID NO: 65 - DNA, 23 bp, artificial sequence
  Guide RNA Recognition Sequence
ctgaagcagaggggatactctgg

SEQ ID NO: 66 - DNA, 23 bp, artificial sequence
  Guide RNA Recognition Sequence
tcacagaacacctgaagcagagg

SEQ ID NO: 67 - DNA, 23 bp, artificial sequence
  Guide RNA Recognition Sequence
acacatctactggctctgcaggg

SEQ ID NO: 68 - DNA, 23 bp, artificial sequence
  Guide RNA Recognition Sequence
atcatccatagacgaaaaagtgg

SEQ ID NO: 69 - DNA, 23 bp, artificial sequence
  Guide RNA Recognition Sequence
atgaccgcgtacaactccggggg

SEQ ID NO: 70 - DNA, 23 bp, artificial sequence
  Guide RNA Recognition Sequence
catgaccgcgtacaactccgggg

SEQ ID NO: 71 - DNA, 23 bp, artificial sequence
  Guide RNA Recognition Sequence
ggcacccccggagttgtacgcgg

SEQ ID NO: 72 - DNA, 23 bp, artificial sequence
  Guide RNA Recognition Sequence
gagttgtacgcggtcatgtgtgg

SEQ ID NO: 73 - DNA, 23 bp, artificial sequence
  Guide RNA Recognition Sequence
acatgaccgcgtacaactccggg

SEQ ID NO: 74 - DNA, 23 bp, artificial sequence
  Guide RNA Recognition Sequence
cacatgaccgcgtacaactccgg

SEQ ID NO: 75 - DNA, 23 bp, artificial sequence
  Guide RNA Recognition Sequence
ttgtacgcggtcatgtgtggtgg

SEQ ID NO: 76 - DNA, 23 bp, artificial sequence
  Guide RNA Recognition Sequence
tggggaacgaacacatccaccgg

SEQ ID NO: 77 - DNA, 23 bp, artificial sequence
  Guide RNA Recognition Sequence
ggtggcactggtccagtcatggg

SEQ ID NO: 78 - DNA, 23 bp, artificial sequence
  Guide RNA Recognition Sequence
cagaataggaatggcacccccgg

SEQ ID NO: 79 - DNA, 23 bp, artificial sequence
  Guide RNA Recognition Sequence
gtggcactggtccagtcatgggg

SEQ ID NO: 80 - DNA, 23 bp, artificial sequence
  Guide RNA Recognition Sequence
gcggtcatgtgtggtggcactgg

SEQ ID NO: 81 - DNA, 23 bp, artificial sequence
  Guide RNA Recognition Sequence
tggtggcactggtccagtcatgg

SEQ ID NO: 82 - DNA, 23 bp, artificial sequence
  Guide RNA Recognition Sequence
gcagcatccgtggggacttctgg

SEQ ID NO: 83 - DNA, 23 bp, artificial sequence
  Guide RNA Recognition Sequence
catccgtggggacttctggctgg

SEQ ID NO: 84 - DNA, 23 bp, artificial sequence
  Guide RNA Recognition Sequence
ggctctccagacagccaacccgg

SEQ ID NO: 85 - DNA, 23 bp, artificial sequence
  Guide RNA Recognition Sequence
atccgtggggacttctggctggg

SEQ ID NO: 86 - DNA, 23 bp, artificial sequence
  Guide RNA Recognition Sequence
ttggctgtctggagagccggtgg

SEQ ID NO: 87 - DNA, 23 bp, artificial sequence
  Guide RNA Recognition Sequence
tggtccagtcatggggcccctgg

SEQ ID NO: 88 - DNA, 23 bp, artificial sequence
  Guide RNA Recognition Sequence
gatttgtcttgaatcagaatagg

SEQ ID NO: 89 - DNA, 23 bp, artificial sequence
  Guide RNA Recognition Sequence
aacccggctgcatgtagagatgg

SEQ ID NO: 90 - DNA, 23 bp, artificial sequence
  Guide RNA Recognition Sequence
ctccatctctacatgcagccggg

SEQ ID NO: 91 - DNA, 23 bp, artificial sequence
  Guide RNA Recognition Sequence
tagagatggaggtaagcacaagg

SEQ ID NO: 92 - DNA, 23 bp, artificial sequence
  Guide RNA Recognition Sequence
tccgtggggacttctggctgggg

SEQ ID NO: 93 - DNA, 23 bp, artificial sequence
  Guide RNA Recognition Sequence
atctctacacacagccgggttgg

SEQ ID NO: 94 - DNA, 23 bp, artificial sequence
  Guide RNA Recognition Sequence
aacccggctgtgtgtagagatgg

SEQ ID NO: 95 - DNA, 23 bp, artificial sequence
  Guide RNA Recognition Sequence
cctccatctctacacacagccgg

SEQ ID NO: 96 - DNA, 23 bp, artificial sequence
  Guide RNA Recognition Sequence
caatggagtgtactaccgcctgg

SEQ ID NO: 97 - DNA, 23 bp, artificial sequence
  Guide RNA Recognition Sequence
aatggagtgtactaccgcctggg

SEQ ID NO: 98 - DNA, 23 bp, artificial sequence
  Guide RNA Recognition Sequence
tacctactccctcaaacgggtgg

SEQ ID NO: 99 - DNA, 23 bp, artificial sequence
  Guide RNA Recognition Sequence
tttcatctccacccgtttgaggg

SEQ ID NO: 100 - DNA, 23 bp, artificial sequence
  Guide RNA Recognition Sequence
acagtcaacttactagcactggg

SEQ ID NO: 101 - DNA, 23 bp, artificial sequence
  Guide RNA Recognition Sequence
ttttcatctccacccgtttgagg

SEQ ID NO: 102 - DNA, 23 bp, artificial sequence
  Guide RNA Recognition Sequence
gggtgagcacaataagcacctgg

SEQ ID NO: 103 - DNA, 23 bp, artificial sequence
  Guide RNA Recognition Sequence
atggcatcacctggtatggctgg

SEQ ID NO: 104 - DNA, 23 bp, artificial sequence
  Guide RNA Recognition Sequence
ctccacccgtttgagggagtagg

SEQ ID NO: 105 - DNA, 23 bp, artificial sequence
  Guide RNA Recognition Sequence
ggtgcttattgtgctcacccagg

SEQ ID NO: 106 - DNA, 23 bp, artificial sequence
  Guide RNA Recognition Sequence
ctaactccttacctgatgtctgg

SEQ ID NO: 107 - DNA, 23 bp, artificial sequence
  Guide RNA Recognition Sequence
cacagtcaacttactagcactgg

SEQ ID NO: 108 - DNA, 23 bp, artificial sequence
  Guide RNA Recognition Sequence
cagttgtaccagtagccacctgg

SEQ ID NO: 109 - DNA, 23 bp, artificial sequence
  Guide RNA Recognition Sequence
gatagaccagacatcaggtaagg

SEQ ID NO: 110 - DNA, 23 bp, artificial sequence
  Guide RNA Recognition Sequence
tcaggtaaggagttagagccagg

SEQ ID NO: 111 - DNA, 23 bp, artificial sequence
  Guide RNA Recognition Sequence
gatctacctactccctcaaacgg

SEQ ID NO: 112 - DNA, 23 bp, artificial sequence
  Guide RNA Recognition Sequence
agatccatgccagccataccagg

SEQ ID NO: 113 - DNA, 23 bp, artificial sequence
  Guide RNA Recognition Sequence
gcttattgtgctcacccaggcgg

SEQ ID NO: 114 - DNA, 23 bp, artificial sequence
  Guide RNA Recognition Sequence
cataccaggtgatgccatccagg

SEQ ID NO: 115 - DNA, 23 bp, artificial sequence
  Guide RNA Recognition Sequence
atctacctactccctcaaacggg

SEQ ID NO: 116 - DNA, 23 bp, artificial sequence
  Guide RNA Recognition Sequence
actgtgatagaccagacatcagg

SEQ ID NO: 117 - DNA, 23 bp, artificial sequence
  Guide RNA Recognition Sequence
ttctcatgccaggtggctactgg

SEQ ID NO: 118 - DNA, 23 bp, artificial sequence
  Guide RNA Recognition Sequence
ctggatggcatcacctggtatgg

SEQ ID NO: 119 - DNA, 23 bp, artificial sequence
  Guide RNA Recognition Sequence
agcacctggatggcatcacctgg

SEQ ID NO: 120 - DNA, 23 bp, artificial sequence
  Guide RNA Recognition Sequence
atcacctggtatggctggcatgg

SEQ ID NO: 121 - DNA, 23 bp, artificial sequence
  Guide RNA Recognition Sequence
gtagtacactccattgagtttgg

SEQ ID NO: 122 - DNA, 23 bp, artificial sequence
  Guide RNA Recognition Sequence
gagcacaataagcacctggatgg

SEQ ID NO: 123 - DNA, 23 bp, artificial sequence
  Guide RNA Recognition Sequence
caggtaaggagttagagccaggg

SEQ ID NO: 124 - DNA, 23 bp, artificial sequence
  Guide RNA Recognition Sequence
ctgggtctgtttctcatgccagg

SEQ ID NO: 125 - DNA, 23 bp, artificial sequence
  Guide RNA Recognition Sequence
tttggtattctttctgaccctgg

SEQ ID NO: 126 - DNA, 23 bp, artificial sequence
  Guide RNA Recognition Sequence
gtcagaaagaataccaaaaccgg

SEQ ID NO: 127 - DNA, 23 bp, artificial sequence
  Guide RNA Recognition Sequence
ggtctgtttctcatgccaggtgg

SEQ ID NO: 128 - DNA, 23 bp, artificial sequence
  Guide RNA Recognition Sequence
ggcggtagtacactccattgagg

SEQ ID NO: 129 - DNA, 23 bp, artificial sequence
  Guide RNA Recognition Sequence
gtagtacactccattgaggttgg

SEQ ID NO: 130 - DNA, 23 bp, artificial sequence
  Guide RNA Recognition Sequence
gtttctgtatccgtgctccacgg

SEQ ID NO: 131 - DNA, 23 bp, artificial sequence
  Guide RNA Recognition Sequence
aaactgagacacgtggagactgg

SEQ ID NO: 132 - DNA, 23 bp, artificial sequence
  Guide RNA Recognition Sequence
gccttaaaaggaggctgccgtgg

SEQ ID NO: 133 - DNA, 23 bp, artificial sequence
  Guide RNA Recognition Sequence
gacacgtggagactggatgaggg

SEQ ID NO: 134 - DNA, 23 bp, artificial sequence
  Guide RNA Recognition Sequence
tccacggcagcctccttttaagg

SEQ ID NO: 135 - DNA, 23 bp, artificial sequence
  Guide RNA Recognition Sequence
tgcacagactccaacctcaatgg

SEQ ID NO: 136 - DNA, 23 bp, artificial sequence
  Guide RNA Recognition Sequence
agacacgtggagactggatgagg

SEQ ID NO: 137 - DNA, 23 bp, artificial sequence
  Guide RNA Recognition Sequence
agacttcaagccttaaaaggagg

SEQ ID NO: 138 - DNA, 23 bp, artificial sequence
  Guide RNA Recognition Sequence
tttaaggcttgaagtcttctggg

SEQ ID NO: 139 - DNA, 23 bp, artificial sequence
  Guide RNA Recognition Sequence
aaggcttgaagtcttctgggtgg

SEQ ID NO: 140 - DNA, 23 bp, artificial sequence
  Guide RNA Recognition Sequence
ttttaaggcttgaagtcttctgg

SEQ ID NO: 141 - DNA, 23 bp, artificial sequence
  Guide RNA Recognition Sequence
gatacagaaactgagacacgtgg

SEQ ID NO: 142 - DNA, 23 bp, artificial sequence
  Guide RNA Recognition Sequence
aaggaggctgccgtggagcacgg

SEQ ID NO: 143 - DNA, 23 bp, artificial sequence
  Guide RNA Recognition Sequence
agaagacttcaagccttaaaagg

SEQ ID NO: 144 - DNA, 23 bp, artificial sequence
  Guide RNA Recognition Sequence
acagaacacctgaagcagagggg

SEQ ID NO: 145 - DNA, 23 bp, artificial sequence
  Guide RNA Recognition Sequence
acagaacacctgaagcagagggg

SEQ ID NO: 146 - DNA, 23 bp, artificial sequence
  Guide RNA Recognition Sequence
cacagaacacctgaagcagaggg

SEQ ID NO: 147 - DNA, 23 bp, artificial sequence
  Guide RNA Recognition Sequence
cagagtatcccctctgcttcagg

SEQ ID NO: 148 - DNA, 23 bp, artificial sequence
  Guide RNA Recognition Sequence
actctggtgagggacttgcaggg

SEQ ID NO: 149 - DNA, 23 bp, artificial sequence
  Guide RNA Recognition Sequence
tactctggtgagggacttgcagg

SEQ ID NO: 150 - DNA, 23 bp, artificial sequence
  Guide RNA Recognition Sequence
gcagaggggatactctggtgagg

SEQ ID NO: 151 - DNA, 23 bp, artificial sequence
  Guide RNA Recognition Sequence
gcttcaggtgttctgtgacatgg

SEQ ID NO: 152 - DNA, 23 bp, artificial sequence
  Guide RNA Recognition Sequence
cagaggggatactctggtgaggg

SEQ ID NO: 153 - DNA, 23 bp, artificial sequence
  Guide RNA Recognition Sequence
ttgtctccttctaccgggactgg

SEQ ID NO: 154 - DNA, 23 bp, artificial sequence
  Guide RNA Recognition Sequence
gtggccttgtctccttctaccgg

SEQ ID NO: 155 - DNA, 23 bp, artificial sequence
  Guide RNA Recognition Sequence
tggccttgtctccttctaccggg

SEQ ID NO: 156 - DNA, 23 bp, artificial sequence
  Guide RNA Recognition Sequence
gactggaagcagtacaagcaggg

SEQ ID NO: 157 - DNA, 23 bp, artificial sequence
  Guide RNA Recognition Sequence
ggactggaagcagtacaagcagg

SEQ ID NO: 158 - DNA, 23 bp, artificial sequence
  Guide RNA Recognition Sequence
ctgcttccagtcccggtagaagg

SEQ ID NO: 159 - DNA, 23 bp, artificial sequence
  Guide RNA Recognition Sequence
gcttgtactgcttccagtcccgg

SEQ ID NO: 160 - DNA, 23 bp, artificial sequence
  Guide RNA Recognition Sequence
agtcccggtagaaggagacaagg

SEQ ID NO: 161 - DNA, 23 bp, artificial sequence
  Guide RNA Recognition Sequence
aagcagtacaagcagggctttgg

SEQ ID NO: 162 - DNA, 23 bp, artificial sequence
  Guide RNA Recognition Sequence
cagggctttggcagcatccgtgg

SEQ ID NO: 163 - DNA, 23 bp, artificial sequence
  Guide RNA Recognition Sequence
agggctttggcagcatccgtggg

SEQ ID NO: 164 - DNA, 23 bp, artificial sequence
  Guide RNA Recognition Sequence
gggctttggcagcatccgtgggg

SEQ ID NO: 165 - DNA, 23 bp, artificial sequence
  Guide RNA Recognition Sequence
tccccagccagaagtccccacgg

SEQ ID NO: 166 - RNA, 20 nt, artificial sequence
  siRNA Antisense Sequence
agcuugagucucugacaggg

SEQ ID NO: 167 - RNA, 20 nt, artificial sequence
  siRNA Antisense Sequence
uuuucucucuuuccuugcuc

SEQ ID NO: 168 - RNA, 20 nt, artificial sequence
  siRNA Antisense Sequence
ccucgccacuuuguuguuuu

SEQ ID NO: 169 - RNA, 20 nt, artificial sequence
  siRNA Antisense Sequence
gccucgccacuuuguuguuu

SEQ ID NO: 170 - RNA, 20 nt, artificial sequence
  siRNA Antisense Sequence
ggccucgccacuuuguuguu

SEQ ID NO: 171 - RNA, 20 nt, artificial sequence
  siRNA Antisense Sequence
gggccucgccacuuuguugu

SEQ ID NO: 172 - RNA, 20 nt, artificial sequence
  siRNA Antisense Sequence
agggccucgccacuuuguug

SEQ ID NO: 173 - RNA, 20 nt, artificial sequence
  siRNA Antisense Sequence
gagggccucgccacuuuguu

SEQ ID NO: 174 - RNA, 20 nt, artificial sequence
  siRNA Antisense Sequence
ugagggccucgccacuuugu

SEQ ID NO: 175 - RNA, 20 nt, artificial sequence
  siRNA Antisense Sequence
ucugagggccucgccacuuu

SEQ ID NO: 176 - RNA, 20 nt, artificial sequence
  siRNA Antisense Sequence
uuucacucugagggccucgc

SEQ ID NO: 177 - RNA, 20 nt, artificial sequence
  siRNA Antisense Sequence
cgcuuucacucugagggccu

SEQ ID NO: 178 - RNA, 20 nt, artificial sequence
  siRNA Antisense Sequence
uacgcuuucacucugagggc

SEQ ID NO: 179 - RNA, 20 nt, artificial sequence
  siRNA Antisense Sequence
uuacgcuuucacucugaggg

SEQ ID NO: 180 - RNA, 20 nt, artificial sequence
  siRNA Antisense Sequence
cuuacgcuuucacucugagg

SEQ ID NO: 181 - RNA, 20 nt, artificial sequence
  siRNA Antisense Sequence
ccuuacgcuuucacucugag

SEQ ID NO: 182 - RNA, 20 nt, artificial sequence
  siRNA Antisense Sequence
aaccuuacgcuuucacucug

SEQ ID NO: 183 - RNA, 20 nt, artificial sequence
  siRNA Antisense Sequence
gaaccuuacgcuuucacucu

SEQ ID NO: 184 - RNA, 20 nt, artificial sequence
  siRNA Antisense Sequence
ugacugaaccuuacgcuuuc

SEQ ID NO: 185 - RNA, 20 nt, artificial sequence
  siRNA Antisense Sequence
cugacugaaccuuacgcuuu

SEQ ID NO: 186 - RNA, 20 nt, artificial sequence
  siRNA Antisense Sequence
gcugacugaaccuuacgcuu

SEQ ID NO: 187 - RNA, 20 nt, artificial sequence
  siRNA Antisense Sequence
ggcugacugaaccuuacgcu

SEQ ID NO: 188 - RNA, 20 nt, artificial sequence
  siRNA Antisense Sequence
aggcugacugaaccuuacgc

SEQ ID NO: 189 - RNA, 20 nt, artificial sequence
  siRNA Antisense Sequence
gguuugggugaggaaggcuc

SEQ ID NO: 190 - RNA, 20 nt, artificial sequence
  siRNA Antisense Sequence
ggguuugggugaggaaggcu

SEQ ID NO: 191 - RNA, 20 nt, artificial sequence
  siRNA Antisense Sequence
uguggguuugggugaggaag

SEQ ID NO: 192 - RNA, 20 nt, artificial sequence
  siRNA Antisense Sequence
uuguggguuugggugaggaa

SEQ ID NO: 193 - RNA, 20 nt, artificial sequence
  siRNA Antisense Sequence
uuuuguggguuugggugagg

SEQ ID NO: 194 - RNA, 20 nt, artificial sequence
  siRNA Antisense Sequence
gaaaaugcagagccagguca

SEQ ID NO: 195 - RNA, 20 nt, artificial sequence
  siRNA Antisense Sequence
ccacgaugaaaaugcagagc

SEQ ID NO: 196 - RNA, 20 nt, artificial sequence
  siRNA Antisense Sequence
gccacgaugaaaaugcagag

SEQ ID NO: 197 - RNA, 20 nt, artificial sequence
  siRNA Antisense Sequence
aggccacgaugaaaaugcag

SEQ ID NO: 198 - RNA, 20 nt, artificial sequence
  siRNA Antisense Sequence
aaaggccacgaugaaaaugc

SEQ ID NO: 199 - RNA, 20 nt, artificial sequence
  siRNA Antisense Sequence
acaaaggccacgaugaaaau

SEQ ID NO: 200 - RNA, 20 nt, artificial sequence
  siRNA Antisense Sequence
ugacaaaggccacgaugaaa

SEQ ID NO: 201 - RNA, 20 nt, artificial sequence
  siRNA Antisense Sequence
cugacaaaggccacgaugaa

SEQ ID NO: 202 - RNA, 20 nt, artificial sequence
  siRNA Antisense Sequence
gcugacaaaggccacgauga

SEQ ID NO: 203 - RNA, 20 nt, artificial sequence
  siRNA Antisense Sequence
ggcugacaaaggccacgaug

SEQ ID NO: 204 - RNA, 20 nt, artificial sequence
  siRNA Antisense Sequence
acgcuggguggcugacaaag

SEQ ID NO: 205 - RNA, 20 nt, artificial sequence
  siRNA Antisense Sequence
gugcuuagagagcuucugca

SEQ ID NO: 206 - RNA, 20 nt, artificial sequence
  siRNA Antisense Sequence
ugugcuuagagagcuucugc

SEQ ID NO: 207 - RNA, 20 nt, artificial sequence
  siRNA Antisense Sequence
uugugcuuagagagcuucug

SEQ ID NO: 208 - RNA, 20 nt, artificial sequence
  siRNA Antisense Sequence
ucuugugcuuagagagcuuc

SEQ ID NO: 209 - RNA, 20 nt, artificial sequence
  siRNA Antisense Sequence
gucuugugcuuagagagcuu

SEQ ID NO: 210 - RNA, 20 nt, artificial sequence
  siRNA Antisense Sequence
ugucuugugcuuagagagcu

SEQ ID NO: 211 - RNA, 20 nt, artificial sequence
  siRNA Antisense Sequence
gugucuugugcuuagagagc

SEQ ID NO: 212 - RNA, 20 nt, artificial sequence
  siRNA Antisense Sequence
ggugucuugugcuuagagag

SEQ ID NO: 213 - RNA, 20 nt, artificial sequence
  siRNA Antisense Sequence
cuggugucuugugcuuagag

SEQ ID NO: 214 - RNA, 20 nt, artificial sequence
  siRNA Antisense Sequence
gcuggugucuugugcuuaga

SEQ ID NO: 215 - RNA, 20 nt, artificial sequence
  siRNA Antisense Sequence
ugugcuggugucuugugcuu

SEQ ID NO: 216 - RNA, 20 nt, artificial sequence
  siRNA Antisense Sequence
cugugcuggugucuugugcu

SEQ ID NO: 217 - RNA, 20 nt, artificial sequence
  siRNA Antisense Sequence
ggcugugcuggugucuugug

SEQ ID NO: 218 - RNA, 20 nt, artificial sequence
  siRNA Antisense Sequence
cgcuuugagcuguggcugug

SEQ ID NO: 219 - RNA, 20 nt, artificial sequence
  siRNA Antisense Sequence
ccgcuuugagcuguggcugu

SEQ ID NO: 220 - RNA, 20 nt, artificial sequence
  siRNA Antisense Sequence
accuccucacagcaguuggc

SEQ ID NO: 221 - RNA, 20 nt, artificial sequence
  siRNA Antisense Sequence
ucaccuccucacagcaguug

SEQ ID NO: 222 - RNA, 20 nt, artificial sequence
  siRNA Antisense Sequence
guuggcaacuugggccuuga

SEQ ID NO: 223 - RNA, 20 nt, artificial sequence
  siRNA Antisense Sequence
gguuggcaacuugggccuug

SEQ ID NO: 224 - RNA, 20 nt, artificial sequence
  siRNA Antisense Sequence
agguuggcaacuugggccuu

SEQ ID NO: 225 - RNA, 20 nt, artificial sequence
  siRNA Antisense Sequence
aagguuggcaacuugggccu

SEQ ID NO: 226 - RNA, 20 nt, artificial sequence
  siRNA Antisense Sequence
uaagguuggcaacuugggcc

SEQ ID NO: 227 - RNA, 20 nt, artificial sequence
  siRNA Antisense Sequence
cuaagguuggcaacuugggc

SEQ ID NO: 228 - RNA, 20 nt, artificial sequence
  siRNA Antisense Sequence
gcuaagguuggcaacuuggg

SEQ ID NO: 229 - RNA, 20 nt, artificial sequence
  siRNA Antisense Sequence
ugcuaagguuggcaacuugg

SEQ ID NO: 230 - RNA, 20 nt, artificial sequence
  siRNA Antisense Sequence
cugcuaagguuggcaacuug

SEQ ID NO: 231 - RNA, 20 nt, artificial sequence
  siRNA Antisense Sequence
gcugcuaagguuggcaacuu

SEQ ID NO: 232 - RNA, 20 nt, artificial sequence
  siRNA Antisense Sequence
ggcugcuaagguuggcaacu

SEQ ID NO: 233 - RNA, 20 nt, artificial sequence
  siRNA Antisense Sequence
aggcugcuaagguuggcaac

SEQ ID NO: 234 - RNA, 20 nt, artificial sequence
  siRNA Antisense Sequence
caggcugcuaagguuggcaa

SEQ ID NO: 235 - RNA, 20 nt, artificial sequence
  siRNA Antisense Sequence
caguucacucagcaggcugc

SEQ ID NO: 236 - RNA, 20 nt, artificial sequence
  siRNA Antisense Sequence
ucaguucacucagcaggcug

SEQ ID NO: 237 - RNA, 20 nt, artificial sequence
  siRNA Antisense Sequence
uucaguucacucagcaggcu

SEQ ID NO: 238 - RNA, 20 nt, artificial sequence
  siRNA Antisense Sequence
guucaguucacucagcaggc

SEQ ID NO: 239 - RNA, 20 nt, artificial sequence
  siRNA Antisense Sequence
cuuguucaguucacucagca

SEQ ID NO: 240 - RNA, 20 nt, artificial sequence
  siRNA Antisense Sequence
ucuuguucaguucacucagc

SEQ ID NO: 241 - RNA, 20 nt, artificial sequence
  siRNA Antisense Sequence
uucuuguucaguucacucag

SEQ ID NO: 242 - RNA, 20 nt, artificial sequence
  siRNA Antisense Sequence
gucccucuccugcuucuugu

SEQ ID NO: 243 - RNA, 20 nt, artificial sequence
  siRNA Antisense Sequence
augaccacgcugacccaguc

SEQ ID NO: 244 - RNA, 20 nt, artificial sequence
  siRNA Antisense Sequence
ugcaugaccacgcugaccca

SEQ ID NO: 245 - RNA, 20 nt, artificial sequence
  siRNA Antisense Sequence
accugcaugaccacgcugac

SEQ ID NO: 246 - RNA, 20 nt, artificial sequence
  siRNA Antisense Sequence
caccugcaugaccacgcuga

SEQ ID NO: 247 - RNA, 20 nt, artificial sequence
  siRNA Antisense Sequence
ucaccugcaugaccacgcug

SEQ ID NO: 248 - RNA, 20 nt, artificial sequence
  siRNA Antisense Sequence
aucaccugcaugaccacgcu

SEQ ID NO: 249 - RNA, 20 nt, artificial sequence
  siRNA Antisense Sequence
cuccaucaccugcaugacca

SEQ ID NO: 250 - RNA, 20 nt, artificial sequence
  siRNA Antisense Sequence
cgcuugcuguugcucuccag

SEQ ID NO: 251 - RNA, 20 nt, artificial sequence
  siRNA Antisense Sequence
gcgcuugcuguugcucucca

SEQ ID NO: 252 - RNA, 20 nt, artificial sequence
  siRNA Antisense Sequence
caugcgcuugcuguugcucu

SEQ ID NO: 253 - RNA, 20 nt, artificial sequence
  siRNA Antisense Sequence
ccaugcgcuugcuguugcuc

SEQ ID NO: 254 - RNA, 20 nt, artificial sequence
  siRNA Antisense Sequence
uccaugcgcuugcuguugcu

SEQ ID NO: 255 - RNA, 20 nt, artificial sequence
  siRNA Antisense Sequence
cuccaugcgcuugcuguugc

SEQ ID NO: 256 - RNA, 20 nt, artificial sequence
  siRNA Antisense Sequence
acuccaugcgcuugcuguug

SEQ ID NO: 257 - RNA, 20 nt, artificial sequence
  siRNA Antisense Sequence
gacuccaugcgcuugcuguu

SEQ ID NO: 258 - RNA, 20 nt, artificial sequence
  siRNA Antisense Sequence
cgacuccaugcgcuugcugu

SEQ ID NO: 259 - RNA, 20 nt, artificial sequence
  siRNA Antisense Sequence
gguuguucaucucggaguac

SEQ ID NO: 260 - RNA, 20 nt, artificial sequence
  siRNA Antisense Sequence
ugguuguucaucucggagua

SEQ ID NO: 261 - RNA, 20 nt, artificial sequence
  siRNA Antisense Sequence
uugguuguucaucucggagu

SEQ ID NO: 262 - RNA, 20 nt, artificial sequence
  siRNA Antisense Sequence
gcaugaugucaauuugguug

SEQ ID NO: 263 - RNA, 20 nt, artificial sequence
  siRNA Antisense Sequence
agcugcaugaugucaauuug

SEQ ID NO: 264 - RNA, 20 nt, artificial sequence
  siRNA Antisense Sequence
agugaccgucugugcugccu

SEQ ID NO: 265 - RNA, 20 nt, artificial sequence
  siRNA Antisense Sequence
ugagugaccgucugugcugc

SEQ ID NO: 266 - RNA, 20 nt, artificial sequence
  siRNA Antisense Sequence
cugagugaccgucugugcug

SEQ ID NO: 267 - RNA, 20 nt, artificial sequence
  siRNA Antisense Sequence
ucugagugaccgucugugcu

SEQ ID NO: 268 - RNA, 20 nt, artificial sequence
  siRNA Antisense Sequence
acuggucuccuuaccugcgg

SEQ ID NO: 269 - RNA, 20 nt, artificial sequence
  siRNA Antisense Sequence
gacuggucuccuuaccugcg

SEQ ID NO: 270 - RNA, 20 nt, artificial sequence
  siRNA Antisense Sequence
ggacuggucuccuuaccugc

SEQ ID NO: 271 - RNA, 20 nt, artificial sequence
  siRNA Antisense Sequence
gaagcagugcuguagauggg

SEQ ID NO: 272 - RNA, 20 nt, artificial sequence
  siRNA Antisense Sequence
uguagaagcagugcuguaga

SEQ ID NO: 273 - RNA, 20 nt, artificial sequence
  siRNA Antisense Sequence
auguagaagcagugcuguag

SEQ ID NO: 274 - RNA, 20 nt, artificial sequence
  siRNA Antisense Sequence
uauguagaagcagugcugua

SEQ ID NO: 275 - RNA, 20 nt, artificial sequence
  siRNA Antisense Sequence
auauguagaagcagugcugu

SEQ ID NO: 276 - RNA, 20 nt, artificial sequence
  siRNA Antisense Sequence
gauauguagaagcagugcug

SEQ ID NO: 277 - RNA, 20 nt, artificial sequence
  siRNA Antisense Sequence
ggauauguagaagcagugcu

SEQ ID NO: 278 - RNA, 20 nt, artificial sequence
  siRNA Antisense Sequence
aggauauguagaagcagugc

SEQ ID NO: 279 - RNA, 20 nt, artificial sequence
  siRNA Antisense Sequence
ccaggauauguagaagcagu

SEQ ID NO: 280 - RNA, 20 nt, artificial sequence
  siRNA Antisense Sequence
ugaccaggauauguagaagc

SEQ ID NO: 281 - RNA, 20 nt, artificial sequence
  siRNA Antisense Sequence
gaugaccaggauauguagaa

SEQ ID NO: 282 - RNA, 20 nt, artificial sequence
  siRNA Antisense Sequence
cugaugaccaggauauguag

SEQ ID NO: 283 - RNA, 20 nt, artificial sequence
  siRNA Antisense Sequence
ucugaugaccaggauaugua

SEQ ID NO: 284 - RNA, 20 nt, artificial sequence
  siRNA Antisense Sequence
guucugaugaccaggauaug

SEQ ID NO: 285 - RNA, 20 nt, artificial sequence
  siRNA Antisense Sequence
gguucugaugaccaggauau

SEQ ID NO: 286 - RNA, 20 nt, artificial sequence
  siRNA Antisense Sequence
caguagugguucugaugacc

SEQ ID NO: 287 - RNA, 20 nt, artificial sequence
  siRNA Antisense Sequence
ccaguagugguucugaugac

SEQ ID NO: 288 - RNA, 20 nt, artificial sequence
  siRNA Antisense Sequence
cccaguagugguucugauga

SEQ ID NO: 289 - RNA, 20 nt, artificial sequence
  siRNA Antisense Sequence
aguguacccacaaaagaggc

SEQ ID NO: 290 - RNA, 20 nt, artificial sequence
  siRNA Antisense Sequence
aaguguacccacaaaagagg

SEQ ID NO: 291 - RNA, 20 nt, artificial sequence
  siRNA Antisense Sequence
aaaguguacccacaaaagag

SEQ ID NO: 292 - RNA, 20 nt, artificial sequence
  siRNA Antisense Sequence
ggaaaguguacccacaaaag

SEQ ID NO: 293 - RNA, 20 nt, artificial sequence
  siRNA Antisense Sequence
gggaaaguguacccacaaaa

SEQ ID NO: 294 - RNA, 20 nt, artificial sequence
  siRNA Antisense Sequence
aagggaaaguguacccacaa

SEQ ID NO: 295 - RNA, 20 nt, artificial sequence
  siRNA Antisense Sequence
cuaaagggaaaguguaccca

SEQ ID NO: 296 - RNA, 20 nt, artificial sequence
  siRNA Antisense Sequence
acuaaagggaaaguguaccc

SEQ ID NO: 297 - RNA, 20 nt, artificial sequence
  siRNA Antisense Sequence
uacuaaagggaaaguguacc

SEQ ID NO: 298 - RNA, 20 nt, artificial sequence
  siRNA Antisense Sequence
aggaaauacugcauaagccu

SEQ ID NO: 299 - RNA, 20 nt, artificial sequence
  siRNA Antisense Sequence
gugaagguguuagguaaacu

SEQ ID NO: 300 - RNA, 20 nt, artificial sequence
  siRNA Antisense Sequence
cgugaagguguuagguaaac

SEQ ID NO: 301 - RNA, 20 nt, artificial sequence
  siRNA Antisense Sequence
ccgugaagguguuagguaaa

SEQ ID NO: 302 - RNA, 20 nt, artificial sequence
  siRNA Antisense Sequence
cccgugaagguguuagguaa

SEQ ID NO: 303 - RNA, 20 nt, artificial sequence
  siRNA Antisense Sequence
acccgugaagguguuaggua

SEQ ID NO: 304 - RNA, 20 nt, artificial sequence
  siRNA Antisense Sequence
gacccgugaagguguuaggu

SEQ ID NO: 305 - RNA, 20 nt, artificial sequence
  siRNA Antisense Sequence
agacccgugaagguguuagg

SEQ ID NO: 306 - RNA, 20 nt, artificial sequence
  siRNA Antisense Sequence
gagacccgugaagguguuag

SEQ ID NO: 307 - RNA, 20 nt, artificial sequence
  siRNA Antisense Sequence
agagacccgugaagguguua

SEQ ID NO: 308 - RNA, 20 nt, artificial sequence
  siRNA Antisense Sequence
aagagacccgugaagguguu

SEQ ID NO: 309 - RNA, 20 nt, artificial sequence
  siRNA Antisense Sequence
aaagagacccgugaaggugu

SEQ ID NO: 310 - RNA, 20 nt, artificial sequence
  siRNA Antisense Sequence
aaaagagacccgugaaggug

SEQ ID NO: 311 - RNA, 20 nt, artificial sequence
  siRNA Antisense Sequence
uaaaagagacccgugaaggu

SEQ ID NO: 312 - RNA, 20 nt, artificial sequence
  siRNA Antisense Sequence
auaaaagagacccgugaagg

SEQ ID NO: 313 - RNA, 20 nt, artificial sequence
  siRNA Antisense Sequence
gauaaaagagacccgugaag

SEQ ID NO: 314 - RNA, 20 nt, artificial sequence
  siRNA Antisense Sequence
ggauaaaagagacccgugaa

SEQ ID NO: 315 - RNA, 20 nt, artificial sequence
  siRNA Antisense Sequence
uggauaaaagagacccguga

SEQ ID NO: 316 - RNA, 20 nt, artificial sequence
  siRNA Antisense Sequence
guggauaaaagagacccgug

SEQ ID NO: 317 - RNA, 20 nt, artificial sequence
  siRNA Antisense Sequence
uguggauaaaagagacccgu

SEQ ID NO: 318 - RNA, 20 nt, artificial sequence
  siRNA Antisense Sequence
acacuguguggauaaaagag

SEQ ID NO: 319 - RNA, 20 nt, artificial sequence
  siRNA Antisense Sequence
gcugaaacacuguguggaua

SEQ ID NO: 320 - RNA, 20 nt, artificial sequence
  siRNA Antisense Sequence
ggcugaaacacuguguggau

SEQ ID NO: 321 - RNA, 20 nt, artificial sequence
  siRNA Antisense Sequence
uaguaucucagcacuccaag

SEQ ID NO: 322 - RNA, 20 nt, artificial sequence
  siRNA Antisense Sequence
guaguaucucagcacuccaa

SEQ ID NO: 323 - RNA, 20 nt, artificial sequence
  siRNA Antisense Sequence
auguaguaucucagcacucc

SEQ ID NO: 324 - RNA, 20 nt, artificial sequence
  siRNA Antisense Sequence
cauguaguaucucagcacuc

SEQ ID NO: 325 - RNA, 20 nt, artificial sequence
  siRNA Antisense Sequence
ccauguaguaucucagcacu

SEQ ID NO: 326 - RNA, 20 nt, artificial sequence
  siRNA Antisense Sequence
accauguaguaucucagcac

SEQ ID NO: 327 - RNA, 20 nt, artificial sequence
  siRNA Antisense Sequence
aaccauguaguaucucagca

SEQ ID NO: 328 - RNA, 20 nt, artificial sequence
  siRNA Antisense Sequence
aaaccauguaguaucucagc

SEQ ID NO: 329 - RNA, 20 nt, artificial sequence
  siRNA Antisense Sequence
caaaccauguaguaucucag

SEQ ID NO: 330 - RNA, 20 nt, artificial sequence
  siRNA Antisense Sequence
ggcaaaccauguaguaucuc

SEQ ID NO: 331 - RNA, 20 nt, artificial sequence
  siRNA Antisense Sequence
uuugggcaaaccauguagua

SEQ ID NO: 332 - RNA, 20 nt, artificial sequence
  siRNA Antisense Sequence
cuuugggcaaaccauguagu

SEQ ID NO: 333 - RNA, 20 nt, artificial sequence
  siRNA Antisense Sequence
ugcuucuaagacuugcuggg

SEQ ID NO: 334 - RNA, 20 nt, artificial sequence
  siRNA Antisense Sequence
aacccugcuucuaagacuug

SEQ ID NO: 335 - RNA, 20 nt, artificial sequence
  siRNA Antisense Sequence
gaacccugcuucuaagacuu

SEQ ID NO: 336 - RNA, 20 nt, artificial sequence
  siRNA Antisense Sequence
ugaacccugcuucuaagacu

SEQ ID NO: 337 - RNA, 20 nt, artificial sequence
  siRNA Antisense Sequence
uugaacccugcuucuaagac

SEQ ID NO: 338 - RNA, 20 nt, artificial sequence
  siRNA Antisense Sequence
gacuugaacccugcuucuaa

SEQ ID NO: 339 - RNA, 20 nt, artificial sequence
  siRNA Antisense Sequence
agacuugaacccugcuucua

SEQ ID NO: 340 - RNA, 20 nt, artificial sequence
  siRNA Antisense Sequence
aagacuugaacccugcuucu

SEQ ID NO: 341 - RNA, 20 nt, artificial sequence
  siRNA Antisense Sequence
aaucaggaagacuugaaccc

SEQ ID NO: 342 - RNA, 20 nt, artificial sequence
  siRNA Antisense Sequence
caaucaggaagacuugaacc

SEQ ID NO: 343 - RNA, 20 nt, artificial sequence
  siRNA Antisense Sequence
ccaaucaggaagacuugaac

SEQ ID NO: 344 - RNA, 20 nt, artificial sequence
  siRNA Antisense Sequence
accaaucaggaagacuugaa

SEQ ID NO: 345 - RNA, 20 nt, artificial sequence
  siRNA Antisense Sequence
acaccaaucaggaagacuug

SEQ ID NO: 346 - RNA, 20 nt, artificial sequence
  siRNA Antisense Sequence
uacaccaaucaggaagacuu

SEQ ID NO: 347 - RNA, 20 nt, artificial sequence
  siRNA Antisense Sequence
cuacaccaaucaggaagacu

SEQ ID NO: 348 - RNA, 20 nt, artificial sequence
  siRNA Antisense Sequence
gcuacaccaaucaggaagac

SEQ ID NO: 349 - RNA, 20 nt, artificial sequence
  siRNA Antisense Sequence
agcuacaccaaucaggaaga

SEQ ID NO: 350 - RNA, 20 nt, artificial sequence
  siRNA Antisense Sequence
gagcuacaccaaucaggaag

SEQ ID NO: 351 - RNA, 20 nt, artificial sequence
  siRNA Antisense Sequence
agagcuacaccaaucaggaa

SEQ ID NO: 352 - RNA, 20 nt, artificial sequence
  siRNA Antisense Sequence
cagagcuacaccaaucagga

SEQ ID NO: 353 - RNA, 20 nt, artificial sequence
  siRNA Antisense Sequence
gcagagcuacaccaaucagg

SEQ ID NO: 354 - RNA, 20 nt, artificial sequence
  siRNA Antisense Sequence
uggugaggaaguagcagagc

SEQ ID NO: 355 - RNA, 20 nt, artificial sequence
  siRNA Antisense Sequence
uuggugaggaaguagcagag

SEQ ID NO: 356 - RNA, 20 nt, artificial sequence
  siRNA Antisense Sequence
cuuggugaggaaguagcaga

SEQ ID NO: 357 - RNA, 20 nt, artificial sequence
  siRNA Antisense Sequence
ucuuggugaggaaguagcag

SEQ ID NO: 358 - RNA, 20 nt, artificial sequence
  siRNA Antisense Sequence
cucuuggugaggaaguagca

SEQ ID NO: 359 - RNA, 20 nt, artificial sequence
  siRNA Antisense Sequence
gcucuuggugaggaaguagc

SEQ ID NO: 360 - RNA, 20 nt, artificial sequence
  siRNA Antisense Sequence
ugucagcucuuggugaggaa

SEQ ID NO: 361 - RNA, 20 nt, artificial sequence
  siRNA Antisense Sequence
cugucagcucuuggugagga

SEQ ID NO: 362 - RNA, 20 nt, artificial sequence
  siRNA Antisense Sequence
agccugucagcucuugguga

SEQ ID NO: 363 - RNA, 20 nt, artificial sequence
  siRNA Antisense Sequence
uauagccugucagcucuugg

SEQ ID NO: 364 - RNA, 20 nt, artificial sequence
  siRNA Antisense Sequence
auauagccugucagcucuug

SEQ ID NO: 365 - RNA, 20 nt, artificial sequence
  siRNA Antisense Sequence
agauauagccugucagcucu

SEQ ID NO: 366 - RNA, 20 nt, artificial sequence
  siRNA Antisense Sequence
ucuugagauauagccuguca

SEQ ID NO: 367 - RNA, 20 nt, artificial sequence
  siRNA Antisense Sequence
uucuugagauauagccuguc

SEQ ID NO: 368 - RNA, 20 nt, artificial sequence
  siRNA Antisense Sequence
ggugcuuccuuggaauuucu

SEQ ID NO: 369 - RNA, 20 nt, artificial sequence
  siRNA Antisense Sequence
aguuuggugcuuccuuggaa

SEQ ID NO: 370 - RNA, 20 nt, artificial sequence
  siRNA Antisense Sequence
caguuuggugcuuccuugga

SEQ ID NO: 371 - RNA, 20 nt, artificial sequence
  siRNA Antisense Sequence
uacaguuuggugcuuccuug

SEQ ID NO: 372 - RNA, 20 nt, artificial sequence
  siRNA Antisense Sequence
guuacaguuuggugcuuccu

SEQ ID NO: 373 - RNA, 20 nt, artificial sequence
  siRNA Antisense Sequence
uguuacaguuuggugcuucc

SEQ ID NO: 374 - RNA, 20 nt, artificial sequence
  siRNA Antisense Sequence
cuguuacaguuuggugcuuc

SEQ ID NO: 375 - RNA, 20 nt, artificial sequence
  siRNA Antisense Sequence
gcuguuacaguuuggugcuu

SEQ ID NO: 376 - RNA, 20 nt, artificial sequence
  siRNA Antisense Sequence
agcuguuacaguuuggugcu

SEQ ID NO: 377 - RNA, 20 nt, artificial sequence
  siRNA Antisense Sequence
cuuaggaacaccagagaacu

SEQ ID NO: 378 - RNA, 20 nt, artificial sequence
  siRNA Antisense Sequence
ucuuaggaacaccagagaac

SEQ ID NO: 379 - RNA, 20 nt, artificial sequence
  siRNA Antisense Sequence
aucuuaggaacaccagagaa

SEQ ID NO: 380 - RNA, 20 nt, artificial sequence
  siRNA Antisense Sequence
aaucuuaggaacaccagaga

SEQ ID NO: 381 - RNA, 20 nt, artificial sequence
  siRNA Antisense Sequence
guaaaucuuaggaacaccag

SEQ ID NO: 382 - RNA, 20 nt, artificial sequence
  siRNA Antisense Sequence
ugguaaaucuuaggaacacc

SEQ ID NO: 383 - RNA, 20 nt, artificial sequence
  siRNA Antisense Sequence
cugguaaaucuuaggaacac

SEQ ID NO: 384 - RNA, 20 nt, artificial sequence
  siRNA Antisense Sequence
ccugguaaaucuuaggaaca

SEQ ID NO: 385 - RNA, 20 nt, artificial sequence
  siRNA Antisense Sequence
cauuccugguaaaucuuagg

SEQ ID NO: 386 - RNA, 20 nt, artificial sequence
  siRNA Antisense Sequence
gcucauuccugguaaaucuu

SEQ ID NO: 387 - RNA, 20 nt, artificial sequence
  siRNA Antisense Sequence
ugcucauuccugguaaaucu

SEQ ID NO: 388 - RNA, 20 nt, artificial sequence
  siRNA Antisense Sequence
augcucauuccugguaaauc

SEQ ID NO: 389 - RNA, 20 nt, artificial sequence
  siRNA Antisense Sequence
cguuuacagagagaggacac

SEQ ID NO: 390 - RNA, 20 nt, artificial sequence
  siRNA Antisense Sequence
uacguuuacagagagaggac

SEQ ID NO: 391 - RNA, 20 nt, artificial sequence
  siRNA Antisense Sequence
guuacguuuacagagagagg

SEQ ID NO: 392 - RNA, 20 nt, artificial sequence
  siRNA Antisense Sequence
aguuacguuuacagagagag

SEQ ID NO: 393 - RNA, 20 nt, artificial sequence
  siRNA Antisense Sequence
gaguuacguuuacagagaga

SEQ ID NO: 394 - RNA, 20 nt, artificial sequence
  siRNA Antisense Sequence
agaguuacguuuacagagag

SEQ ID NO: 395 - RNA, 20 nt, artificial sequence
  siRNA Antisense Sequence
gaagaguuacguuuacagag

SEQ ID NO: 396 - RNA, 20 nt, artificial sequence
  siRNA Antisense Sequence
gagaagaguuacguuuacag

SEQ ID NO: 397 - RNA, 20 nt, artificial sequence
  siRNA Antisense Sequence
ccaaugagaagaguuacguu

SEQ ID NO: 398 - RNA, 20 nt, artificial sequence
  siRNA Antisense Sequence
gccaaugagaagaguuacgu

SEQ ID NO: 399 - RNA, 20 nt, artificial sequence
  siRNA Antisense Sequence
gagccaaugagaagaguuac

SEQ ID NO: 400 - RNA, 20 nt, artificial sequence
  siRNA Antisense Sequence
ugagccaaugagaagaguua

SEQ ID NO: 401 - RNA, 20 nt, artificial sequence
  siRNA Antisense Sequence
cuacacuuaacucugagcca

SEQ ID NO: 402 - RNA, 20 nt, artificial sequence
  siRNA Antisense Sequence
ucuacacuuaacucugagcc

SEQ ID NO: 403 - RNA, 20 nt, artificial sequence
  siRNA Antisense Sequence
cucuacacuuaacucugagc

SEQ ID NO: 404 - RNA, 20 nt, artificial sequence
  siRNA Antisense Sequence
ucucuacacuuaacucugag

SEQ ID NO: 405 - RNA, 20 nt, artificial sequence
  siRNA Antisense Sequence
ugucucuacacuuaacucug

SEQ ID NO: 406 - RNA, 20 nt, artificial sequence
  siRNA Antisense Sequence
caugguuaugugucucuaca

SEQ ID NO: 407 - RNA, 20 nt, artificial sequence
  siRNA Antisense Sequence
ggacucuucacaugguuaug

SEQ ID NO: 408 - RNA, 20 nt, artificial sequence
  siRNA Antisense Sequence
gggacucuucacaugguuau

SEQ ID NO: 409 - RNA, 20 nt, artificial sequence
  siRNA Antisense Sequence
aagggacucuucacaugguu

SEQ ID NO: 410 - RNA, 20 nt, artificial sequence
  siRNA Antisense Sequence
acaaagggacucuucacaug

SEQ ID NO: 411 - RNA, 20 nt, artificial sequence
  siRNA Antisense Sequence
aacacaaagggacucuucac

SEQ ID NO: 412 - RNA, 20 nt, artificial sequence
  siRNA Antisense Sequence
gaacacaaagggacucuuca

SEQ ID NO: 413 - RNA, 20 nt, artificial sequence
  siRNA Antisense Sequence
uccugaacacaaagggacuc

SEQ ID NO: 414 - RNA, 20 nt, artificial sequence
  siRNA Antisense Sequence
cuuccugaacacaaagggac

SEQ ID NO: 415 - RNA, 20 nt, artificial sequence
  siRNA Antisense Sequence
cauccuuccugaacacaaag

SEQ ID NO: 416 - RNA, 20 nt, artificial sequence
  siRNA Antisense Sequence
gcauccuuccugaacacaaa

SEQ ID NO: 417 - RNA, 20 nt, artificial sequence
  siRNA Antisense Sequence
ccgcauccuuccugaacaca

SEQ ID NO: 418 - RNA, 20 nt, artificial sequence
  siRNA Antisense Sequence
agccgcauccuuccugaaca

SEQ ID NO: 419 - RNA, 20 nt, artificial sequence
  siRNA Antisense Sequence
gagccgcauccuuccugaac

SEQ ID NO: 420 - RNA, 20 nt, artificial sequence
  siRNA Antisense Sequence
ccuguauucggagaaauuca

SEQ ID NO: 421 - RNA, 20 nt, artificial sequence
  siRNA Antisense Sequence
uccuguauucggagaaauuc

SEQ ID NO: 422 - RNA, 20 nt, artificial sequence
  siRNA Antisense Sequence
gagcugagcuaaccagaaau

SEQ ID NO: 423 - RNA, 20 nt, artificial sequence
  siRNA Antisense Sequence
ugagcugagcuaaccagaaa

SEQ ID NO: 424 - RNA, 20 nt, artificial sequence
  siRNA Antisense Sequence
cugagcugagcuaaccagaa

SEQ ID NO: 425 - RNA, 20 nt, artificial sequence
  siRNA Antisense Sequence
ccugagcugagcuaaccaga

SEQ ID NO: 426 - RNA, 20 nt, artificial sequence
  siRNA Antisense Sequence
accugagcugagcuaaccag

SEQ ID NO: 427 - RNA, 20 nt, artificial sequence
  siRNA Antisense Sequence
ccaccugagcugagcuaacc

SEQ ID NO: 428 - RNA, 20 nt, artificial sequence
  siRNA Antisense Sequence
cccaccugagcugagcuaac

SEQ ID NO: 429 - RNA, 20 nt, artificial sequence
  siRNA Antisense Sequence
uguuggcccaccugagcuga

SEQ ID NO: 430 - RNA, 20 nt, artificial sequence
  siRNA Antisense Sequence
auguuggcccaccugagcug

SEQ ID NO: 431 - RNA, 20 nt, artificial sequence
  siRNA Antisense Sequence
uucauguuggcccaccugag

SEQ ID NO: 432 - RNA, 20 nt, artificial sequence
  siRNA Antisense Sequence
auucauguuggcccaccuga

SEQ ID NO: 433 - RNA, 20 nt, artificial sequence
  siRNA Antisense Sequence
aaauucauguuggcccaccu

SEQ ID NO: 434 - RNA, 20 nt, artificial sequence
  siRNA Antisense Sequence
uaaauucauguuggcccacc

SEQ ID NO: 435 - RNA, 20 nt, artificial sequence
  siRNA Antisense Sequence
guaaauucauguuggcccac

SEQ ID NO: 436 - RNA, 20 nt, artificial sequence
  siRNA Antisense Sequence
guugguucagguaacagaau

SEQ ID NO: 437 - RNA, 20 nt, artificial sequence
  siRNA Antisense Sequence
ccaugcuuagaaagugauug

SEQ ID NO: 438 - RNA, 20 nt, artificial sequence
  siRNA Antisense Sequence
aaguccaugcuuagaaagug

SEQ ID NO: 439 - RNA, 20 nt, artificial sequence
  siRNA Antisense Sequence
ggaaguccaugcuuagaaag

SEQ ID NO: 440 - RNA, 20 nt, artificial sequence
  siRNA Antisense Sequence
cggaaguccaugcuuagaaa

SEQ ID NO: 441 - RNA, 20 nt, artificial sequence
  siRNA Antisense Sequence
ccggaaguccaugcuuagaa

SEQ ID NO: 442 - RNA, 20 nt, artificial sequence
  siRNA Antisense Sequence
cccggaaguccaugcuuaga

SEQ ID NO: 443 - RNA, 20 nt, artificial sequence
  siRNA Antisense Sequence
uuucuaaucccaaacugagg

SEQ ID NO: 444 - RNA, 20 nt, artificial sequence
  siRNA Antisense Sequence
cuuucuaaucccaaacugag

SEQ ID NO: 445 - RNA, 20 nt, artificial sequence
  siRNA Antisense Sequence
ccuuucuaaucccaaacuga

SEQ ID NO: 446 - RNA, 20 nt, artificial sequence
  siRNA Antisense Sequence
accuuucuaaucccaaacug

SEQ ID NO: 447 - RNA, 20 nt, artificial sequence
  siRNA Antisense Sequence
auggccugagaauaccuuuc

SEQ ID NO: 448 - RNA, 20 nt, artificial sequence
  siRNA Antisense Sequence
aauggccugagaauaccuuu

SEQ ID NO: 449 - RNA, 20 nt, artificial sequence
  siRNA Antisense Sequence
aaauggccugagaauaccuu

SEQ ID NO: 450 - RNA, 20 nt, artificial sequence
  siRNA Antisense Sequence
aaaauggccugagaauaccu

SEQ ID NO: 451 - RNA, 20 nt, artificial sequence
  siRNA Antisense Sequence
uggaaaauggccugagaaua

SEQ ID NO: 452 - RNA, 20 nt, artificial sequence
  siRNA Antisense Sequence
acuugucuggaaaauggccu

SEQ ID NO: 453 - RNA, 20 nt, artificial sequence
  siRNA Antisense Sequence
cacuugucuggaaaauggcc

SEQ ID NO: 454 - RNA, 20 nt, artificial sequence
  siRNA Antisense Sequence
ucacuugucuggaaaauggc

SEQ ID NO: 455 - RNA, 20 nt, artificial sequence
  siRNA Antisense Sequence
ggacucacuugucuggaaaa

SEQ ID NO: 456 - RNA, 20 nt, artificial sequence
  siRNA Antisense Sequence
aaucaggacucacuugucug

SEQ ID NO: 457 - RNA, 20 nt, artificial sequence
  siRNA Antisense Sequence
aaaucaggacucacuugucu

SEQ ID NO: 458 - RNA, 20 nt, artificial sequence
  siRNA Antisense Sequence
caaaucaggacucacuuguc

SEQ ID NO: 459 - RNA, 20 nt, artificial sequence
  siRNA Antisense Sequence
ccaaaucaggacucacuugu

SEQ ID NO: 460 - RNA, 20 nt, artificial sequence
  siRNA Antisense Sequence
gaccaaaucaggacucacuu

SEQ ID NO: 461 - RNA, 20 nt, artificial sequence
  siRNA Antisense Sequence
agaccaaaucaggacucacu

SEQ ID NO: 462 - RNA, 20 nt, artificial sequence
  siRNA Antisense Sequence
cagaccaaaucaggacucac

SEQ ID NO: 463 - RNA, 20 nt, artificial sequence
  siRNA Antisense Sequence
cacagaccaaaucaggacuc

SEQ ID NO: 464 - RNA, 20 nt, artificial sequence
  siRNA Antisense Sequence
ucacagaccaaaucaggacu

SEQ ID NO: 465 - RNA, 20 nt, artificial sequence
  siRNA Antisense Sequence
cucacagaccaaaucaggac

SEQ ID NO: 466 - RNA, 20 nt, artificial sequence
  siRNA Antisense Sequence
ucucacagaccaaaucagga

SEQ ID NO: 467 - RNA, 20 nt, artificial sequence
  siRNA Antisense Sequence
aucucacagaccaaaucagg

SEQ ID NO: 468 - RNA, 20 nt, artificial sequence
  siRNA Antisense Sequence
caucucacagaccaaaucag

SEQ ID NO: 469 - RNA, 20 nt, artificial sequence
  siRNA Antisense Sequence
guuucaucucacagaccaaa

SEQ ID NO: 470 - RNA, 20 nt, artificial sequence
  siRNA Antisense Sequence
gguuucaucucacagaccaa

SEQ ID NO: 471 - RNA, 20 nt, artificial sequence
  siRNA Antisense Sequence
cugguuucaucucacagacc

SEQ ID NO: 472 - RNA, 20 nt, artificial sequence
  siRNA Antisense Sequence
caugucugguuucaucucac

SEQ ID NO: 473 - RNA, 20 nt, artificial sequence
  siRNA Antisense Sequence
gcaugucugguuucaucuca

SEQ ID NO: 474 - RNA, 20 nt, artificial sequence
  siRNA Antisense Sequence
cgcaugucugguuucaucuc

SEQ ID NO: 475 - RNA, 20 nt, artificial sequence
  siRNA Antisense Sequence
uccgcaugucugguuucauc

SEQ ID NO: 476 - RNA, 20 nt, artificial sequence
  siRNA Antisense Sequence
uuccgcaugucugguuucau

SEQ ID NO: 477 - RNA, 20 nt, artificial sequence
  siRNA Antisense Sequence
cuuccgcaugucugguuuca

SEQ ID NO: 478 - RNA, 20 nt, artificial sequence
  siRNA Antisense Sequence
ucuuccgcaugucugguuuc

SEQ ID NO: 479 - RNA, 20 nt, artificial sequence
  siRNA Antisense Sequence
gucuuccgcaugucugguuu

SEQ ID NO: 480 - RNA, 20 nt, artificial sequence
  siRNA Antisense Sequence
ggucuuccgcaugucugguu

SEQ ID NO: 481 - RNA, 20 nt, artificial sequence
  siRNA Antisense Sequence
uggucuuccgcaugucuggu

SEQ ID NO: 482 - RNA, 20 nt, artificial sequence
  siRNA Antisense Sequence
cuggucuuccgcaugucugg

SEQ ID NO: 483 - RNA, 20 nt, artificial sequence
  siRNA Antisense Sequence
ccuggucuuccgcaugucug

SEQ ID NO: 484 - RNA, 20 nt, artificial sequence
  siRNA Antisense Sequence
gccuggucuuccgcaugucu

SEQ ID NO: 485 - RNA, 20 nt, artificial sequence
  siRNA Antisense Sequence
uggccuggucuuccgcaugu

SEQ ID NO: 486 - RNA, 20 nt, artificial sequence
  siRNA Antisense Sequence
ucugucuggccuggucuucc

SEQ ID NO: 487 - RNA, 20 nt, artificial sequence
  siRNA Antisense Sequence
cucugucuggccuggucuuc

SEQ ID NO: 488 - RNA, 20 nt, artificial sequence
  siRNA Antisense Sequence
ccucugucuggccuggucuu

SEQ ID NO: 489 - RNA, 20 nt, artificial sequence
  siRNA Antisense Sequence
auuccucugucuggccuggu

SEQ ID NO: 490 - RNA, 20 nt, artificial sequence
  siRNA Antisense Sequence
gauuccucugucuggccugg

SEQ ID NO: 491 - RNA, 20 nt, artificial sequence
  siRNA Antisense Sequence
agauuccucugucuggccug

SEQ ID NO: 492 - RNA, 20 nt, artificial sequence
  siRNA Antisense Sequence
uggcacggucagauuccucu

SEQ ID NO: 493 - RNA, 20 nt, artificial sequence
  siRNA Antisense Sequence
guggcacggucagauuccuc

SEQ ID NO: 494 - RNA, 20 nt, artificial sequence
  siRNA Antisense Sequence
aguggcacggucagauuccu

SEQ ID NO: 495 - RNA, 20 nt, artificial sequence
  siRNA Antisense Sequence
aaguggcacggucagauucc

SEQ ID NO: 496 - RNA, 20 nt, artificial sequence
  siRNA Antisense Sequence
gaaguggcacggucagauuc

SEQ ID NO: 497 - RNA, 20 nt, artificial sequence
  siRNA Antisense Sequence
ggaaguggcacggucagauu

SEQ ID NO: 498 - RNA, 20 nt, artificial sequence
  siRNA Antisense Sequence
aggaaguggcacggucagau

SEQ ID NO: 499 - RNA, 20 nt, artificial sequence
  siRNA Antisense Sequence
caggaaguggcacggucaga

SEQ ID NO: 500 - RNA, 20 nt, artificial sequence
  siRNA Antisense Sequence
agcaggaaguggcacgguca

SEQ ID NO: 501 - RNA, 20 nt, artificial sequence
  siRNA Antisense Sequence
guuuggaugagcaggaagug

SEQ ID NO: 502 - RNA, 20 nt, artificial sequence
  siRNA Antisense Sequence
uguuuggaugagcaggaagu

SEQ ID NO: 503 - RNA, 20 nt, artificial sequence
  siRNA Antisense Sequence
ccuccuguuuggaugagcag

SEQ ID NO: 504 - RNA, 20 nt, artificial sequence
  siRNA Antisense Sequence
gccuccuguuuggaugagca

SEQ ID NO: 505 - RNA, 20 nt, artificial sequence
  siRNA Antisense Sequence
agccuccuguuuggaugagc

SEQ ID NO: 506 - RNA, 20 nt, artificial sequence
  siRNA Antisense Sequence
aagccuccuguuuggaugag

SEQ ID NO: 507 - RNA, 20 nt, artificial sequence
  siRNA Antisense Sequence
aaagccuccuguuuggauga

SEQ ID NO: 508 - RNA, 20 nt, artificial sequence
  siRNA Antisense Sequence
gaaagccuccuguuuggaug

SEQ ID NO: 509 - RNA, 20 nt, artificial sequence
  siRNA Antisense Sequence
ugagaaagccuccuguuugg

SEQ ID NO: 510 - RNA, 20 nt, artificial sequence
  siRNA Antisense Sequence
gugagaaagccuccuguuug

SEQ ID NO: 511 - RNA, 20 nt, artificial sequence
  siRNA Antisense Sequence
ggugagaaagccuccuguuu

SEQ ID NO: 512 - RNA, 20 nt, artificial sequence
  siRNA Antisense Sequence
auggugagaaagccuccugu

SEQ ID NO: 513 - RNA, 20 nt, artificial sequence
  siRNA Antisense Sequence
caggauggugagaaagccuc

SEQ ID NO: 514 - RNA, 20 nt, artificial sequence
  siRNA Antisense Sequence
gcaggauggugagaaagccu

SEQ ID NO: 515 - RNA, 20 nt, artificial sequence
  siRNA Antisense Sequence
ugggagagcugcacuugacc

SEQ ID NO: 516 - RNA, 20 nt, artificial sequence
  siRNA Antisense Sequence
gugggagagcugcacuugac

SEQ ID NO: 517 - RNA, 20 nt, artificial sequence
  siRNA Antisense Sequence
ggugggagagcugcacuuga

SEQ ID NO: 518 - RNA, 20 nt, artificial sequence
  siRNA Antisense Sequence
uggugggagagcugcacuug

SEQ ID NO: 519 - RNA, 20 nt, artificial sequence
  siRNA Antisense Sequence
cuggugggagagcugcacuu

SEQ ID NO: 520 - RNA, 20 nt, artificial sequence
  siRNA Antisense Sequence
augauguccugggcaagaag

SEQ ID NO: 521 - RNA, 20 nt, artificial sequence
  siRNA Antisense Sequence
aaugauguccugggcaagaa

SEQ ID NO: 522 - RNA, 20 nt, artificial sequence
  siRNA Antisense Sequence
gaaugauguccugggcaaga

SEQ ID NO: 523 - RNA, 20 nt, artificial sequence
  siRNA Antisense Sequence
ggaaugauguccugggcaag

SEQ ID NO: 524 - RNA, 20 nt, artificial sequence
  siRNA Antisense Sequence
gaauauaaggguaacugagc

SEQ ID NO: 525 - RNA, 20 nt, artificial sequence
  siRNA Antisense Sequence
gggacuaccuacuuauagaa

SEQ ID NO: 526 - RNA, 20 nt, artificial sequence
  siRNA Antisense Sequence
agggacuaccuacuuauaga

SEQ ID NO: 527 - RNA, 20 nt, artificial sequence
  siRNA Antisense Sequence
ugaaagcaccaacuuacugc

SEQ ID NO: 528 - RNA, 20 nt, artificial sequence
  siRNA Antisense Sequence
gugaaagcaccaacuuacug

SEQ ID NO: 529 - RNA, 20 nt, artificial sequence
  siRNA Antisense Sequence
cgucuuaguggugaaagcac

SEQ ID NO: 530 - RNA, 20 nt, artificial sequence
  siRNA Antisense Sequence
ucgucuuaguggugaaagca

SEQ ID NO: 531 - RNA, 20 nt, artificial sequence
  siRNA Antisense Sequence
uucgucuuaguggugaaagc

SEQ ID NO: 532 - RNA, 20 nt, artificial sequence
  siRNA Antisense Sequence
cauuucgucuuaguggugaa

SEQ ID NO: 533 - RNA, 20 nt, artificial sequence
  siRNA Antisense Sequence
ucauuucgucuuagugguga

SEQ ID NO: 534 - RNA, 20 nt, artificial sequence
  siRNA Antisense Sequence
uucauuucgucuuaguggug

SEQ ID NO: 535 - RNA, 20 nt, artificial sequence
  siRNA Antisense Sequence
cuucauuucgucuuaguggu

SEQ ID NO: 536 - RNA, 20 nt, artificial sequence
  siRNA Antisense Sequence
ucuucauuucgucuuagugg

SEQ ID NO: 537 - RNA, 20 nt, artificial sequence
  siRNA Antisense Sequence
agguagaguacgugugccuu

SEQ ID NO: 538 - RNA, 20 nt, artificial sequence
  siRNA Antisense Sequence
gagguagaguacgugugccu

SEQ ID NO: 539 - RNA, 20 nt, artificial sequence
  siRNA Antisense Sequence
ggagguagaguacgugugcc

SEQ ID NO: 540 - RNA, 20 nt, artificial sequence
  siRNA Antisense Sequence
gggagguagaguacgugugc

SEQ ID NO: 541 - RNA, 20 nt, artificial sequence
  siRNA Antisense Sequence
agggagguagaguacgugug

SEQ ID NO: 542 - RNA, 20 nt, artificial sequence
  siRNA Antisense Sequence
aagggagguagaguacgugu

SEQ ID NO: 543 - RNA, 20 nt, artificial sequence
  siRNA Antisense Sequence
aaagggagguagaguacgug

SEQ ID NO: 544 - RNA, 20 nt, artificial sequence
  siRNA Antisense Sequence
gaaagggagguagaguacgu

SEQ ID NO: 545 - RNA, 20 nt, artificial sequence
  siRNA Antisense Sequence
cacauagguucucuugcaga

SEQ ID NO: 546 - RNA, 20 nt, artificial sequence
  siRNA Antisense Sequence
aggcacauagguucucuugc

SEQ ID NO: 547 - RNA, 20 nt, artificial sequence
  siRNA Antisense Sequence
gaggcacauagguucucuug

SEQ ID NO: 548 - RNA, 20 nt, artificial sequence
  siRNA Antisense Sequence
cugaggcacauagguucucu

SEQ ID NO: 549 - RNA, 20 nt, artificial sequence
  siRNA Antisense Sequence
ucugaggcacauagguucuc

SEQ ID NO: 550 - RNA, 20 nt, artificial sequence
  siRNA Antisense Sequence
gucugaggcacauagguucu

SEQ ID NO: 551 - RNA, 20 nt, artificial sequence
  siRNA Antisense Sequence
ugucugaggcacauagguuc

SEQ ID NO: 552 - RNA, 20 nt, artificial sequence
  siRNA Antisense Sequence
uugucugaggcacauagguu

SEQ ID NO: 553 - RNA, 20 nt, artificial sequence
  siRNA Antisense Sequence
uagagaggagcaccaagaug

SEQ ID NO: 554 - RNA, 20 nt, artificial sequence
  siRNA Antisense Sequence
uuagagaggagcaccaagau

SEQ ID NO: 555 - RNA, 20 nt, artificial sequence
  siRNA Antisense Sequence
cuuagagaggagcaccaaga

SEQ ID NO: 556 - RNA, 20 nt, artificial sequence
  siRNA Antisense Sequence
accuuagagaggagcaccaa

SEQ ID NO: 557 - RNA, 20 nt, artificial sequence
  siRNA Antisense Sequence
gaccuuagagaggagcacca

SEQ ID NO: 558 - RNA, 20 nt, artificial sequence
  siRNA Antisense Sequence
ggaccuuagagaggagcacc

SEQ ID NO: 559 - RNA, 20 nt, artificial sequence
  siRNA Antisense Sequence
ugggaccuuagagaggagca

SEQ ID NO: 560 - RNA, 20 nt, artificial sequence
  siRNA Antisense Sequence
cugggaccuuagagaggagc

SEQ ID NO: 561 - RNA, 20 nt, artificial sequence
  siRNA Antisense Sequence
cacugggaccuuagagagga

SEQ ID NO: 562 - RNA, 20 nt, artificial sequence
  siRNA Antisense Sequence
gcacugggaccuuagagagg

SEQ ID NO: 563 - RNA, 20 nt, artificial sequence
  siRNA Antisense Sequence
ugcacugggaccuuagagag

SEQ ID NO: 564 - RNA, 20 nt, artificial sequence
  siRNA Antisense Sequence
acugcacugggaccuuagag

SEQ ID NO: 565 - RNA, 20 nt, artificial sequence
  siRNA Antisense Sequence
gaccacugcacugggaccuu

SEQ ID NO: 566 - RNA, 20 nt, artificial sequence
  siRNA Antisense Sequence
uuggugaccacugcacuggg

SEQ ID NO: 567 - RNA, 20 nt, artificial sequence
  siRNA Antisense Sequence
cuuggugaccacugcacugg

SEQ ID NO: 568 - RNA, 20 nt, artificial sequence
  siRNA Antisense Sequence
ucuuggugaccacugcacug

SEQ ID NO: 569 - RNA, 20 nt, artificial sequence
  siRNA Antisense Sequence
uucuuggugaccacugcacu

SEQ ID NO: 570 - RNA, 20 nt, artificial sequence
  siRNA Antisense Sequence
uuucuuggugaccacugcac

SEQ ID NO: 571 - RNA, 20 nt, artificial sequence
  siRNA Antisense Sequence
cuuuucuuggugaccacugc

SEQ ID NO: 572 - RNA, 20 nt, artificial sequence
  siRNA Antisense Sequence
ggugcuuuucuuggugacca

SEQ ID NO: 573 - RNA, 20 nt, artificial sequence
  siRNA Antisense Sequence
gggugcuuuucuuggugacc

SEQ ID NO: 574 - RNA, 20 nt, artificial sequence
  siRNA Antisense Sequence
agcuuccugccugcuauguc

SEQ ID NO: 575 - RNA, 20 nt, artificial sequence
  siRNA Antisense Sequence
acagccuuuucugauaggau

SEQ ID NO: 576 - RNA, 20 nt, artificial sequence
  siRNA Antisense Sequence
gacagccuuuucugauagga

SEQ ID NO: 577 - RNA, 20 nt, artificial sequence
  siRNA Antisense Sequence
gaagagacagccuuuucuga

SEQ ID NO: 578 - RNA, 20 nt, artificial sequence
  siRNA Antisense Sequence
ggaagagacagccuuuucug

SEQ ID NO: 579 - RNA, 20 nt, artificial sequence
  siRNA Antisense Sequence
auaguggaagagacagccuu

SEQ ID NO: 580 - RNA, 20 nt, artificial sequence
  siRNA Antisense Sequence
gcauaguggaagagacagcc

SEQ ID NO: 581 - RNA, 20 nt, artificial sequence
  siRNA Antisense Sequence
agcauaguggaagagacagc

SEQ ID NO: 582 - RNA, 20 nt, artificial sequence
  siRNA Antisense Sequence
gagcauaguggaagagacag

SEQ ID NO: 583 - RNA, 20 nt, artificial sequence
  siRNA Antisense Sequence
aagagcauaguggaagagac

SEQ ID NO: 584 - RNA, 20 nt, artificial sequence
  siRNA Antisense Sequence
uaugcaggauuuaagcucug

SEQ ID NO: 585 - RNA, 20 nt, artificial sequence
  siRNA Antisense Sequence
uggagcugcuacuuuaugca

SEQ ID NO: 586 - RNA, 20 nt, artificial sequence
  siRNA Antisense Sequence
augagagcaucagacuggcc

SEQ ID NO: 587 - RNA, 20 nt, artificial sequence
  siRNA Antisense Sequence
aaugagagcaucagacuggc

SEQ ID NO: 588 - RNA, 20 nt, artificial sequence
  siRNA Antisense Sequence
ccucccagaaguuuuguuaa

SEQ ID NO: 589 - RNA, 20 nt, artificial sequence
  siRNA Antisense Sequence
uccucccagaaguuuuguua

SEQ ID NO: 590 - RNA, 20 nt, artificial sequence
  siRNA Antisense Sequence
ucagaagaaccuuugaggcc

SEQ ID NO: 591 - RNA, 20 nt, artificial sequence
  siRNA Antisense Sequence
acacucagaagaaccuuuga

SEQ ID NO: 592 - RNA, 20 nt, artificial sequence
  siRNA Antisense Sequence
aacacucagaagaaccuuug

SEQ ID NO: 593 - RNA, 20 nt, artificial sequence
  siRNA Antisense Sequence
uagcaccucaaaacacucag

SEQ ID NO: 594 - RNA, 20 nt, artificial sequence
  siRNA Antisense Sequence
cuagcaccucaaaacacuca

SEQ ID NO: 595 - RNA, 20 nt, artificial sequence
  siRNA Antisense Sequence
ugccaccugagaccauaauu

SEQ ID NO: 596 - RNA, 20 nt, artificial sequence
  siRNA Antisense Sequence
acugccaccugagaccauaa

SEQ ID NO: 597 - RNA, 20 nt, artificial sequence
  siRNA Antisense Sequence
uacugccaccugagaccaua

SEQ ID NO: 598 - RNA, 20 nt, artificial sequence
  siRNA Antisense Sequence
cagagaugguggcuacugcc

SEQ ID NO: 599 - RNA, 20 nt, artificial sequence
  siRNA Antisense Sequence
ucagagaugguggcuacugc

SEQ ID NO: 600 - RNA, 20 nt, artificial sequence
  siRNA Antisense Sequence
guucagagaugguggcuacu

SEQ ID NO: 601 - RNA, 20 nt, artificial sequence
  siRNA Antisense Sequence
uguucagagaugguggcuac

SEQ ID NO: 602 - RNA, 20 nt, artificial sequence
  siRNA Antisense Sequence
uguuguucagagaugguggc

SEQ ID NO: 603 - RNA, 20 nt, artificial sequence
  siRNA Antisense Sequence
uuguuguucagagauggugg

SEQ ID NO: 604 - RNA, 20 nt, artificial sequence
  siRNA Antisense Sequence
guuguuguucagagauggug

SEQ ID NO: 605 - RNA, 20 nt, artificial sequence
  siRNA Antisense Sequence
auguuuccugguugguuguu

SEQ ID NO: 606 - RNA, 20 nt, artificial sequence
  siRNA Antisense Sequence
ucucauagagucugguuuug

SEQ ID NO: 607 - RNA, 20 nt, artificial sequence
  siRNA Antisense Sequence
gaauaucucauagagucugg

SEQ ID NO: 608 - RNA, 20 nt, artificial sequence
  siRNA Antisense Sequence
gucgugaauaucucauagag

SEQ ID NO: 609 - RNA, 20 nt, artificial sequence
  siRNA Antisense Sequence
cagucgugaauaucucauag

SEQ ID NO: 610 - RNA, 20 nt, artificial sequence
  siRNA Antisense Sequence
ccacuauaacaaaucagucg

SEQ ID NO: 611 - RNA, 20 nt, artificial sequence
  siRNA Antisense Sequence
gccacuauaacaaaucaguc

SEQ ID NO: 612 - RNA, 20 nt, artificial sequence
  siRNA Antisense Sequence
ccgccacuauaacaaaucag

SEQ ID NO: 613 - RNA, 20 nt, artificial sequence
  siRNA Antisense Sequence
cagacuucuuagacagccgc

SEQ ID NO: 614 - RNA, 20 nt, artificial sequence
  siRNA Antisense Sequence
ucagacuucuuagacagccg

SEQ ID NO: 615 - RNA, 20 nt, artificial sequence
  siRNA Antisense Sequence
uucagacuucuuagacagcc

SEQ ID NO: 616 - RNA, 20 nt, artificial sequence
  siRNA Antisense Sequence
auucagacuucuuagacagc

SEQ ID NO: 617 - RNA, 20 nt, artificial sequence
  siRNA Antisense Sequence
gucagauagauucagacuuc

SEQ ID NO: 618 - RNA, 20 nt, artificial sequence
  siRNA Antisense Sequence
cugucagauagauucagacu

SEQ ID NO: 619 - RNA, 20 nt, artificial sequence
  siRNA Antisense Sequence
uccugucagauagauucaga

SEQ ID NO: 620 - RNA, 20 nt, artificial sequence
  siRNA Antisense Sequence
cuccugucagauagauucag

SEQ ID NO: 621 - RNA, 20 nt, artificial sequence
  siRNA Antisense Sequence
acuccugucagauagauuca

SEQ ID NO: 622 - RNA, 20 nt, artificial sequence
  siRNA Antisense Sequence
uacuccugucagauagauuc

SEQ ID NO: 623 - RNA, 20 nt, artificial sequence
  siRNA Antisense Sequence
gauacuccugucagauagau

SEQ ID NO: 624 - RNA, 20 nt, artificial sequence
  siRNA Antisense Sequence
agauacuccugucagauaga

SEQ ID NO: 625 - RNA, 20 nt, artificial sequence
  siRNA Antisense Sequence
ccacguaacagauacuccug

SEQ ID NO: 626 - RNA, 20 nt, artificial sequence
  siRNA Antisense Sequence
gccacguaacagauacuccu

SEQ ID NO: 627 - RNA, 20 nt, artificial sequence
  siRNA Antisense Sequence
ggccacguaacagauacucc

SEQ ID NO: 628 - RNA, 20 nt, artificial sequence
  siRNA Antisense Sequence
gggccacguaacagauacuc

SEQ ID NO: 629 - RNA, 20 nt, artificial sequence
  siRNA Antisense Sequence
agggccacguaacagauacu

SEQ ID NO: 630 - RNA, 20 nt, artificial sequence
  siRNA Antisense Sequence
gagggccacguaacagauac

SEQ ID NO: 631 - RNA, 20 nt, artificial sequence
  siRNA Antisense Sequence
ugagggccacguaacagaua

SEQ ID NO: 632 - RNA, 20 nt, artificial sequence
  siRNA Antisense Sequence
augagggccacguaacagau

SEQ ID NO: 633 - RNA, 20 nt, artificial sequence
  siRNA Antisense Sequence
uaugagggccacguaacaga

SEQ ID NO: 634 - RNA, 20 nt, artificial sequence
  siRNA Antisense Sequence
guaugagggccacguaacag

SEQ ID NO: 635 - RNA, 20 nt, artificial sequence
  siRNA Antisense Sequence
uguaugagggccacguaaca

SEQ ID NO: 636 - RNA, 20 nt, artificial sequence
  siRNA Antisense Sequence
guguaugagggccacguaac

SEQ ID NO: 637 - RNA, 20 nt, artificial sequence
  siRNA Antisense Sequence
aguguaugagggccacguaa

SEQ ID NO: 638 - RNA, 20 nt, artificial sequence
  siRNA Antisense Sequence
uacaguguaugagggccacg

SEQ ID NO: 639 - RNA, 20 nt, artificial sequence
  siRNA Antisense Sequence
uuacaguguaugagggccac

SEQ ID NO: 640 - RNA, 20 nt, artificial sequence
  siRNA Antisense Sequence
guuacaguguaugagggcca

SEQ ID NO: 641 - RNA, 20 nt, artificial sequence
  siRNA Antisense Sequence
auguuacaguguaugagggc

SEQ ID NO: 642 - RNA, 20 nt, artificial sequence
  siRNA Antisense Sequence
aacaggugguuucagguuaa

SEQ ID NO: 643 - RNA, 20 nt, artificial sequence
  siRNA Antisense Sequence
acguuccaacaggugguuuc

SEQ ID NO: 644 - RNA, 20 nt, artificial sequence
  siRNA Antisense Sequence
gacguuccaacaggugguuu

SEQ ID NO: 645 - RNA, 20 nt, artificial sequence
  siRNA Antisense Sequence
ggacguuccaacaggugguu

SEQ ID NO: 646 - RNA, 20 nt, artificial sequence
  siRNA Antisense Sequence
gggacguuccaacagguggu

SEQ ID NO: 647 - RNA, 20 nt, artificial sequence
  siRNA Antisense Sequence
ugggacguuccaacaggugg

SEQ ID NO: 648 - RNA, 20 nt, artificial sequence
  siRNA Antisense Sequence
gugggacguuccaacaggug

SEQ ID NO: 649 - RNA, 20 nt, artificial sequence
  siRNA Antisense Sequence
agugggacguuccaacaggu

SEQ ID NO: 650 - RNA, 20 nt, artificial sequence
  siRNA Antisense Sequence
uagugggacguuccaacagg

SEQ ID NO: 651 - RNA, 20 nt, artificial sequence
  siRNA Antisense Sequence
uuagugggacguuccaacag

SEQ ID NO: 652 - RNA, 20 nt, artificial sequence
  siRNA Antisense Sequence
auuagugggacguuccaaca

SEQ ID NO: 653 - RNA, 20 nt, artificial sequence
  siRNA Antisense Sequence
cauuagugggacguuccaac

SEQ ID NO: 654 - RNA, 20 nt, artificial sequence
  siRNA Antisense Sequence
gcauuagugggacguuccaa

SEQ ID NO: 655 - RNA, 20 nt, artificial sequence
  siRNA Antisense Sequence
agcauuagugggacguucca

SEQ ID NO: 656 - RNA, 20 nt, artificial sequence
  siRNA Antisense Sequence
uagcauuagugggacguucc

SEQ ID NO: 657 - RNA, 20 nt, artificial sequence
  siRNA Antisense Sequence
auagcauuagugggacguuc

SEQ ID NO: 658 - RNA, 20 nt, artificial sequence
  siRNA Antisense Sequence
gauagcauuagugggacguu

SEQ ID NO: 659 - RNA, 20 nt, artificial sequence
  siRNA Antisense Sequence
ggauagcauuagugggacgu

SEQ ID NO: 660 - RNA, 20 nt, artificial sequence
  siRNA Antisense Sequence
uggauagcauuagugggacg

SEQ ID NO: 661 - RNA, 20 nt, artificial sequence
  siRNA Antisense Sequence
cuggauagcauuagugggac

SEQ ID NO: 662 - RNA, 20 nt, artificial sequence
  siRNA Antisense Sequence
ccuggauagcauuaguggga

SEQ ID NO: 663 - RNA, 20 nt, artificial sequence
  siRNA Antisense Sequence
accuggauagcauuaguggg

SEQ ID NO: 664 - RNA, 20 nt, artificial sequence
  siRNA Antisense Sequence
caccuggauagcauuagugg

SEQ ID NO: 665 - RNA, 20 nt, artificial sequence
  siRNA Antisense Sequence
ucaccuggauagcauuagug

SEQ ID NO: 666 - RNA, 20 nt, artificial sequence
  siRNA Antisense Sequence
uucaccuggauagcauuagu

SEQ ID NO: 667 - RNA, 20 nt, artificial sequence
  siRNA Antisense Sequence
cuucaccuggauagcauuag

SEQ ID NO: 668 - RNA, 20 nt, artificial sequence
  siRNA Antisense Sequence
ccuucaccuggauagcauua

SEQ ID NO: 669 - RNA, 20 nt, artificial sequence
  siRNA Antisense Sequence
cccuucaccuggauagcauu

SEQ ID NO: 670 - RNA, 20 nt, artificial sequence
  siRNA Antisense Sequence
agcccuucaccuggauagca

SEQ ID NO: 671 - RNA, 20 nt, artificial sequence
  siRNA Antisense Sequence
aagcccuucaccuggauagc

SEQ ID NO: 672 - RNA, 20 nt, artificial sequence
  siRNA Antisense Sequence
gaagcccuucaccuggauag

SEQ ID NO: 673 - RNA, 20 nt, artificial sequence
  siRNA Antisense Sequence
uacuagcgguggagcagagg

SEQ ID NO: 674 - RNA, 20 nt, artificial sequence
  siRNA Antisense Sequence
uuacuagcgguggagcagag

SEQ ID NO: 675 - RNA, 20 nt, artificial sequence
  siRNA Antisense Sequence
uuuacuagcgguggagcaga

SEQ ID NO: 676 - RNA, 20 nt, artificial sequence
  siRNA Antisense Sequence
cuuuacuagcgguggagcag

SEQ ID NO: 677 - RNA, 20 nt, artificial sequence
  siRNA Antisense Sequence
gcuuuacuagcgguggagca

SEQ ID NO: 678 - RNA, 20 nt, artificial sequence
  siRNA Antisense Sequence
ggcuuuacuagcgguggagc

SEQ ID NO: 679 - RNA, 20 nt, artificial sequence
  siRNA Antisense Sequence
uggcuuuacuagcgguggag

SEQ ID NO: 680 - RNA, 20 nt, artificial sequence
  siRNA Antisense Sequence
uuggcuuuacuagcggugga

SEQ ID NO: 681 - RNA, 20 nt, artificial sequence
  siRNA Antisense Sequence
uuuggcuuuacuagcggugg

SEQ ID NO: 682 - RNA, 20 nt, artificial sequence
  siRNA Antisense Sequence
uuuuggcuuuacuagcggug

SEQ ID NO: 683 - RNA, 20 nt, artificial sequence
  siRNA Antisense Sequence
auuuuggcuuuacuagcggu

SEQ ID NO: 684 - RNA, 20 nt, artificial sequence
  siRNA Antisense Sequence
uauuuuggcuuuacuagcgg

SEQ ID NO: 685 - RNA, 20 nt, artificial sequence
  siRNA Antisense Sequence
guauuuuggcuuuacuagcg

SEQ ID NO: 686 - RNA, 20 nt, artificial sequence
  siRNA Antisense Sequence
ggguguauuuuggcuuuacu

SEQ ID NO: 687 - RNA, 20 nt, artificial sequence
  siRNA Antisense Sequence
uugggagagguggauauggg

SEQ ID NO: 688 - RNA, 20 nt, artificial sequence
  siRNA Antisense Sequence
ugcauuugggagagguggau

SEQ ID NO: 689 - RNA, 20 nt, artificial sequence
  siRNA Antisense Sequence
cagugucugcauuugggaga

SEQ ID NO: 690 - RNA, 20 nt, artificial sequence
  siRNA Antisense Sequence
uacccaucagugucugcauu

SEQ ID NO: 691 - RNA, 20 nt, artificial sequence
  siRNA Antisense Sequence
auuacccaucagugucugca

SEQ ID NO: 692 - RNA, 20 nt, artificial sequence
  siRNA Antisense Sequence
aauuacccaucagugucugc

SEQ ID NO: 693 - RNA, 20 nt, artificial sequence
  siRNA Antisense Sequence
cuacccugggauucucagug

SEQ ID NO: 694 - RNA, 20 nt, artificial sequence
  siRNA Antisense Sequence
uucuacccugggauucucag

SEQ ID NO: 695 - RNA, 20 nt, artificial sequence
  siRNA Antisense Sequence
uuucuacccugggauucuca

SEQ ID NO: 696 - RNA, 20 nt, artificial sequence
  siRNA Antisense Sequence
auuucuacccugggauucuc

SEQ ID NO: 697 - RNA, 20 nt, artificial sequence
  siRNA Antisense Sequence
uauuucuacccugggauucu

SEQ ID NO: 698 - RNA, 20 nt, artificial sequence
  siRNA Antisense Sequence
uuauuucuacccugggauuc

SEQ ID NO: 699 - RNA, 20 nt, artificial sequence
  siRNA Antisense Sequence
cuuuauuucuacccugggau

SEQ ID NO: 700 - RNA, 20 nt, artificial sequence
  siRNA Antisense Sequence
agccuuuauuucuacccugg

SEQ ID NO: 701 - RNA, 20 nt, artificial sequence
  siRNA Antisense Sequence
acugagccuuuauuucuacc

SEQ ID NO: 702 - RNA, 20 nt, artificial sequence
  siRNA Antisense Sequence
gacugagccuuuauuucuac

SEQ ID NO: 703 - RNA, 20 nt, artificial sequence
  siRNA Antisense Sequence
guuuagagacugagccuuua

SEQ ID NO: 704 - RNA, 20 nt, artificial sequence
  siRNA Antisense Sequence
uguuuagagacugagccuuu

SEQ ID NO: 705 - RNA, 20 nt, artificial sequence
  siRNA Antisense Sequence
guguuuagagacugagccuu

SEQ ID NO: 706 - RNA, 20 nt, artificial sequence
  siRNA Antisense Sequence
gaguguuuagagacugagcc

SEQ ID NO: 707 - RNA, 20 nt, artificial sequence
  siRNA Antisense Sequence
ugaguguuuagagacugagc

SEQ ID NO: 708 - RNA, 20 nt, artificial sequence
  siRNA Antisense Sequence
uugaguguuuagagacugag

SEQ ID NO: 709 - RNA, 20 nt, artificial sequence
  siRNA Antisense Sequence
aguugaguguuuagagacug

SEQ ID NO: 710 - RNA, 20 nt, artificial sequence
  siRNA Antisense Sequence
gaguugaguguuuagagacu

SEQ ID NO: 711 - RNA, 20 nt, artificial sequence
  siRNA Antisense Sequence
ugaguugaguguuuagagac

SEQ ID NO: 712 - RNA, 20 nt, artificial sequence
  siRNA Antisense Sequence
ucugaguugaguguuuagag

SEQ ID NO: 713 - RNA, 20 nt, artificial sequence
  siRNA Antisense Sequence
ccaucugaguugaguguuua

SEQ ID NO: 714 - RNA, 20 nt, artificial sequence
  siRNA Antisense Sequence
uccaucugaguugaguguuu

SEQ ID NO: 715 - RNA, 20 nt, artificial sequence
  siRNA Antisense Sequence
gcuccaucugaguugagugu

SEQ ID NO: 716 - RNA, 20 nt, artificial sequence
  siRNA Antisense Sequence
acccaguggcuccaucugag

SEQ ID NO: 717 - RNA, 20 nt, artificial sequence
  siRNA Antisense Sequence
uuuagacccaguggcuccau

SEQ ID NO: 718 - RNA, 20 nt, artificial sequence
  siRNA Antisense Sequence
auuuagacccaguggcucca

SEQ ID NO: 719 - RNA, 20 nt, artificial sequence
  siRNA Antisense Sequence
cauuuagacccaguggcucc

SEQ ID NO: 720 - RNA, 20 nt, artificial sequence
  siRNA Antisense Sequence
ugagcauuuagacccagugg

SEQ ID NO: 721 - RNA, 20 nt, artificial sequence
  siRNA Antisense Sequence
gugagcauuuagacccagug

SEQ ID NO: 722 - RNA, 20 nt, artificial sequence
  siRNA Antisense Sequence
ggugagcauuuagacccagu

SEQ ID NO: 723 - RNA, 20 nt, artificial sequence
  siRNA Antisense Sequence
acagggugagcauuuagacc

SEQ ID NO: 724 - RNA, 20 nt, artificial sequence
  siRNA Antisense Sequence
accacagggugagcauuuag

SEQ ID NO: 725 - RNA, 20 nt, artificial sequence
  siRNA Antisense Sequence
aaaccacagggugagcauuu

SEQ ID NO: 726 - RNA, 20 nt, artificial sequence
  siRNA Antisense Sequence
gaacaaaccacagggugagc

SEQ ID NO: 727 - RNA, 20 nt, artificial sequence
  siRNA Antisense Sequence
agaacaaaccacagggugag

SEQ ID NO: 728 - RNA, 20 nt, artificial sequence
  siRNA Antisense Sequence
aagagaacaaaccacagggu

SEQ ID NO: 729 - RNA, 20 nt, artificial sequence
  siRNA Antisense Sequence
gagcagucguagauggcauc

SEQ ID NO: 730 - RNA, 20 nt, artificial sequence
  siRNA Antisense Sequence
agagcagucguagauggcau

SEQ ID NO: 731 - RNA, 20 nt, artificial sequence
  siRNA Antisense Sequence
aagagcagucguagauggca

SEQ ID NO: 732 - RNA, 20 nt, artificial sequence
  siRNA Antisense Sequence
gaagagcagucguagauggc

SEQ ID NO: 733 - RNA, 20 nt, artificial sequence
  siRNA Antisense Sequence
ggaagagcagucguagaugg

SEQ ID NO: 734 - RNA, 20 nt, artificial sequence
  siRNA Antisense Sequence
gggaagagcagucguagaug

SEQ ID NO: 735 - RNA, 20 nt, artificial sequence
  siRNA Antisense Sequence
agggaagagcagucguagau

SEQ ID NO: 736 - RNA, 20 nt, artificial sequence
  siRNA Antisense Sequence
gagggaagagcagucguaga

SEQ ID NO: 737 - RNA, 20 nt, artificial sequence
  siRNA Antisense Sequence
gguaguucuucugguagagg

SEQ ID NO: 738 - RNA, 20 nt, artificial sequence
  siRNA Antisense Sequence
agcuuauacacuccagagau

SEQ ID NO: 739 - RNA, 20 nt, artificial sequence
  siRNA Antisense Sequence
gaagucaucaggaggaagcu

SEQ ID NO: 740 - RNA, 20 nt, artificial sequence
  siRNA Antisense Sequence
ggaagucaucaggaggaagc

SEQ ID NO: 741 - RNA, 20 nt, artificial sequence
  siRNA Antisense Sequence
gcccaggaagucaucaggag

SEQ ID NO: 742 - RNA, 20 nt, artificial sequence
  siRNA Antisense Sequence
gcugcccaggaagucaucag

SEQ ID NO: 743 - RNA, 20 nt, artificial sequence
  siRNA Antisense Sequence
aguucagggcugcccaggaa

SEQ ID NO: 744 - RNA, 20 nt, artificial sequence
  siRNA Antisense Sequence
cucaccuccaguucagggcu

SEQ ID NO: 745 - RNA, 20 nt, artificial sequence
  siRNA Antisense Sequence
accucaccuccaguucaggg

SEQ ID NO: 746 - RNA, 20 nt, artificial sequence
  siRNA Antisense Sequence
uaaugaccucaccuccaguu

SEQ ID NO: 747 - RNA, 20 nt, artificial sequence
  siRNA Antisense Sequence
guaaugaccucaccuccagu

SEQ ID NO: 748 - RNA, 20 nt, artificial sequence
  siRNA Antisense Sequence
cuguaaugaccucaccucca

SEQ ID NO: 749 - RNA, 20 nt, artificial sequence
  siRNA Antisense Sequence
ugacuguaaugaccucaccu

SEQ ID NO: 750 - RNA, 20 nt, artificial sequence
  siRNA Antisense Sequence
ccagugacuguaaugaccuc

SEQ ID NO: 751 - RNA, 20 nt, artificial sequence
  siRNA Antisense Sequence
gacagguauuagggcauggc

SEQ ID NO: 752 - RNA, 20 nt, artificial sequence
  siRNA Antisense Sequence
ggacagguauuagggcaugg

SEQ ID NO: 753 - RNA, 20 nt, artificial sequence
  siRNA Antisense Sequence
aggacagguauuagggcaug

SEQ ID NO: 754 - RNA, 20 nt, artificial sequence
  siRNA Antisense Sequence
aaggacagguauuagggcau

SEQ ID NO: 755 - RNA, 20 nt, artificial sequence
  siRNA Antisense Sequence
ggcccuguuguuguaguccc

SEQ ID NO: 756 - RNA, 20 nt, artificial sequence
  siRNA Antisense Sequence
uggcccuguuguuguagucc

SEQ ID NO: 757 - RNA, 20 nt, artificial sequence
  siRNA Antisense Sequence
auggcccuguuguuguaguc

SEQ ID NO: 758 - RNA, 20 nt, artificial sequence
  siRNA Antisense Sequence
aauggcccuguuguuguagu

SEQ ID NO: 759 - RNA, 20 nt, artificial sequence
  siRNA Antisense Sequence
gaauggcccuguuguuguag

SEQ ID NO: 760 - RNA, 20 nt, artificial sequence
  siRNA Antisense Sequence
gugaauggcccuguuguugu

SEQ ID NO: 761 - RNA, 20 nt, artificial sequence
  siRNA Antisense Sequence
ugugaauggcccuguuguug

SEQ ID NO: 762 - RNA, 20 nt, artificial sequence
  siRNA Antisense Sequence
acugugaauggcccuguugu

SEQ ID NO: 763 - RNA, 20 nt, artificial sequence
  siRNA Antisense Sequence
uuaaacugugaauggcccug

SEQ ID NO: 764 - RNA, 20 nt, artificial sequence
  siRNA Antisense Sequence
cagccgaauuuuccuuucuu

SEQ ID NO: 765 - RNA, 20 nt, artificial sequence
  siRNA Antisense Sequence
cccagccgaauuuuccuuuc

SEQ ID NO: 766 - RNA, 20 nt, artificial sequence
  siRNA Antisense Sequence
ccauagugcugggauuacag

SEQ ID NO: 767 - RNA, 20 nt, artificial sequence
  siRNA Antisense Sequence
aagugauccaccugccucgg

SEQ ID NO: 768 - RNA, 20 nt, artificial sequence
  siRNA Antisense Sequence
gaagugauccaccugccucg

SEQ ID NO: 769 - RNA, 20 nt, artificial sequence
  siRNA Antisense Sequence
ugaagugauccaccugccuc

SEQ ID NO: 770 - RNA, 20 nt, artificial sequence
  siRNA Antisense Sequence
cugaagugauccaccugccu

SEQ ID NO: 771 - RNA, 20 nt, artificial sequence
  siRNA Antisense Sequence
ccugaagugauccaccugcc

SEQ ID NO: 772 - RNA, 20 nt, artificial sequence
  siRNA Antisense Sequence
accugaagugauccaccugc

SEQ ID NO: 773 - RNA, 20 nt, artificial sequence
  siRNA Antisense Sequence
ggccaggcuggucuuaaacu

SEQ ID NO: 774 - RNA, 20 nt, artificial sequence
  siRNA Antisense Sequence
aggguuucaccauguuggcc

SEQ ID NO: 775 - RNA, 20 nt, artificial sequence
  siRNA Antisense Sequence
caggguuucaccauguuggc

SEQ ID NO: 776 - RNA, 20 nt, artificial sequence
  siRNA Antisense Sequence
acaggguuucaccauguugg

SEQ ID NO: 777 - RNA, 20 nt, artificial sequence
  siRNA Antisense Sequence
gacaggguuucaccauguug

SEQ ID NO: 778 - RNA, 20 nt, artificial sequence
  siRNA Antisense Sequence
agacaggguuucaccauguu

SEQ ID NO: 779 - RNA, 20 nt, artificial sequence
  siRNA Antisense Sequence
gagacaggguuucaccaugu

SEQ ID NO: 780 - RNA, 20 nt, artificial sequence
  siRNA Antisense Sequence
agagacaggguuucaccaug

SEQ ID NO: 781 - RNA, 20 nt, artificial sequence
  siRNA Antisense Sequence
uagagacaggguuucaccau

SEQ ID NO: 782 - RNA, 20 nt, artificial sequence
  siRNA Antisense Sequence
guagagacaggguuucacca

SEQ ID NO: 783 - RNA, 20 nt, artificial sequence
  siRNA Antisense Sequence
caccaugccuggcuaauuuu

SEQ ID NO: 784 - RNA, 20 nt, artificial sequence
  siRNA Antisense Sequence
ccaccaugccuggcuaauuu

SEQ ID NO: 785 - RNA, 20 nt, artificial sequence
  siRNA Antisense Sequence
accaccaugccuggcuaauu

SEQ ID NO: 786 - RNA, 20 nt, artificial sequence
  siRNA Antisense Sequence
caccaccaugccuggcuaau

SEQ ID NO: 787 - RNA, 20 nt, artificial sequence
  siRNA Antisense Sequence
ccaccaccaugccuggcuaa

SEQ ID NO: 788 - RNA, 20 nt, artificial sequence
  siRNA Antisense Sequence
aaccucugccuccugaguuc

SEQ ID NO: 789 - RNA, 20 nt, artificial sequence
  siRNA Antisense Sequence
caaccucugccuccugaguu

SEQ ID NO: 790 - RNA, 20 nt, artificial sequence
  siRNA Antisense Sequence
gcaaccucugccuccugagu

SEQ ID NO: 791 - RNA, 20 nt, artificial sequence
  siRNA Antisense Sequence
ugcaaccucugccuccugag

SEQ ID NO: 792 - RNA, 20 nt, artificial sequence
  siRNA Antisense Sequence
cugcaaccucugccuccuga

SEQ ID NO: 793 - RNA, 20 nt, artificial sequence
  siRNA Antisense Sequence
acugcaaccucugccuccug

SEQ ID NO: 794 - RNA, 20 nt, artificial sequence
  siRNA Antisense Sequence
cacugcaaccucugccuccu

SEQ ID NO: 795 - RNA, 20 nt, artificial sequence
  siRNA Antisense Sequence
ucacugcaaccucugccucc

SEQ ID NO: 796 - RNA, 20 nt, artificial sequence
  siRNA Antisense Sequence
cucacugcaaccucugccuc

SEQ ID NO: 797 - RNA, 20 nt, artificial sequence
  siRNA Antisense Sequence
gcucacugcaaccucugccu

SEQ ID NO: 798 - RNA, 20 nt, artificial sequence
  siRNA Antisense Sequence
ucggcucacugcaaccucug

SEQ ID NO: 799 - RNA, 20 nt, artificial sequence
  siRNA Antisense Sequence
cucggcucacugcaaccucu

SEQ ID NO: 800 - RNA, 20 nt, artificial sequence
  siRNA Antisense Sequence
ucucggcucacugcaaccuc

SEQ ID NO: 801 - RNA, 20 nt, artificial sequence
  siRNA Antisense Sequence
aucucggcucacugcaaccu

SEQ ID NO: 802 - RNA, 20 nt, artificial sequence
  siRNA Antisense Sequence
gaucucggcucacugcaacc

SEQ ID NO: 803 - RNA, 20 nt, artificial sequence
  siRNA Antisense Sequence
ugaucucggcucacugcaac

SEQ ID NO: 804 - RNA, 20 nt, artificial sequence
  siRNA Antisense Sequence
aguggcgugaucucggcuca

SEQ ID NO: 805 - RNA, 20 nt, artificial sequence
  siRNA Antisense Sequence
agugcaguggcgugaucucg

SEQ ID NO: 806 - RNA, 20 nt, artificial sequence
  siRNA Antisense Sequence
uagugcaguggcgugaucuc

SEQ ID NO: 807 - RNA, 20 nt, artificial sequence
  siRNA Antisense Sequence
auagugcaguggcgugaucu

SEQ ID NO: 808 - RNA, 20 nt, artificial sequence
  siRNA Antisense Sequence
uauagugcaguggcgugauc

SEQ ID NO: 809 - RNA, 20 nt, artificial sequence
  siRNA Antisense Sequence
uuauagugcaguggcgugau

SEQ ID NO: 810 - RNA, 20 nt, artificial sequence
  siRNA Antisense Sequence
auuauagugcaguggcguga

SEQ ID NO: 811 - RNA, 20 nt, artificial sequence
  siRNA Antisense Sequence
gauuauagugcaguggcgug

SEQ ID NO: 812 - RNA, 20 nt, artificial sequence
  siRNA Antisense Sequence
cagauuauagugcaguggcg

SEQ ID NO: 813 - RNA, 20 nt, artificial sequence
  siRNA Antisense Sequence
gucucccagauuauagugca

SEQ ID NO: 814 - RNA, 20 nt, artificial sequence
  siRNA Antisense Sequence
ugucucccagauuauagugc

SEQ ID NO: 815 - RNA, 20 nt, artificial sequence
  siRNA Antisense Sequence
uugucucccagauuauagug

SEQ ID NO: 816 - RNA, 20 nt, artificial sequence
  siRNA Antisense Sequence
gcuuguguuugaguuuuccu

SEQ ID NO: 817 - RNA, 20 nt, artificial sequence
  siRNA Antisense Sequence
ugcuuguguuugaguuuucc

SEQ ID NO: 818 - RNA, 20 nt, artificial sequence
  siRNA Antisense Sequence
gguguuugguguguuugcuu

SEQ ID NO: 819 - RNA, 20 nt, artificial sequence
  siRNA Antisense Sequence
cugugguguuugguguguuu

SEQ ID NO: 820 - RNA, 20 nt, artificial sequence
  siRNA Antisense Sequence
agcucugugguguuuggugu

SEQ ID NO: 821 - RNA, 20 nt, artificial sequence
  siRNA Antisense Sequence
auagcucugugguguuuggu

SEQ ID NO: 822 - RNA, 20 nt, artificial sequence
  siRNA Antisense Sequence
uugcauagcucugugguguu

SEQ ID NO: 823 - RNA, 20 nt, artificial sequence
  siRNA Antisense Sequence
uuugcauagcucuguggugu

SEQ ID NO: 824 - RNA, 20 nt, artificial sequence
  siRNA Antisense Sequence
guuugcauagcucuguggug

SEQ ID NO: 825 - RNA, 20 nt, artificial sequence
  siRNA Antisense Sequence
gaguguuugcauagcucugu

SEQ ID NO: 826 - RNA, 20 nt, artificial sequence
  siRNA Antisense Sequence
cugaguguuugcauagcucu

SEQ ID NO: 827 - RNA, 20 nt, artificial sequence
  siRNA Antisense Sequence
acugaguguuugcauagcuc

SEQ ID NO: 828 - RNA, 20 nt, artificial sequence
  siRNA Antisense Sequence
ugcagggcauaaacugagug

SEQ ID NO: 829 - RNA, 20 nt, artificial sequence
  siRNA Antisense Sequence
agugcagggcauaaacugag

SEQ ID NO: 830 - RNA, 20 nt, artificial sequence
  siRNA Antisense Sequence
gagugcagggcauaaacuga

SEQ ID NO: 831 - RNA, 20 nt, artificial sequence
  siRNA Antisense Sequence
ggagugcagggcauaaacug

SEQ ID NO: 832 - RNA, 20 nt, artificial sequence
  siRNA Antisense Sequence
uggagugcagggcauaaacu

SEQ ID NO: 833 - RNA, 20 nt, artificial sequence
  siRNA Antisense Sequence
augccuggguuuggagugca

SEQ ID NO: 834 - RNA, 20 nt, artificial sequence
  siRNA Antisense Sequence
gccaaacagaugccuggguu

SEQ ID NO: 835 - RNA, 20 nt, artificial sequence
  siRNA Antisense Sequence
aauagcuguucuaggacaug

SEQ ID NO: 836 - RNA, 20 nt, artificial sequence
  siRNA Antisense Sequence
gaauagcuguucuaggacau

SEQ ID NO: 837 - RNA, 20 nt, artificial sequence
  siRNA Antisense Sequence
caaggaauagcuguucuagg

SEQ ID NO: 838 - RNA, 20 nt, artificial sequence
  siRNA Antisense Sequence
cccaaggaauagcuguucua

SEQ ID NO: 839 - RNA, 20 nt, artificial sequence
  siRNA Antisense Sequence
ccuucguguuuucuuuucuc

SEQ ID NO: 840 - RNA, 20 nt, artificial sequence
  siRNA Antisense Sequence
gccuucguguuuucuuuucu

SEQ ID NO: 841 - RNA, 20 nt, artificial sequence
  siRNA Antisense Sequence
ugccuucguguuuucuuuuc

SEQ ID NO: 842 - RNA, 20 nt, artificial sequence
  siRNA Antisense Sequence
cugccuucguguuuucuuuu

SEQ ID NO: 843 - RNA, 20 nt, artificial sequence
  siRNA Antisense Sequence
gcugccuucguguuuucuuu

SEQ ID NO: 844 - RNA, 20 nt, artificial sequence
  siRNA Antisense Sequence
ugcugccuucguguuuucuu

SEQ ID NO: 845 - RNA, 20 nt, artificial sequence
  siRNA Antisense Sequence
augcugccuucguguuuucu

SEQ ID NO: 846 - RNA, 20 nt, artificial sequence
  siRNA Antisense Sequence
uugaugcugccuucguguuu

SEQ ID NO: 847 - RNA, 20 nt, artificial sequence
  siRNA Antisense Sequence
uuugaugcugccuucguguu

SEQ ID NO: 848 - RNA, 20 nt, artificial sequence
  siRNA Antisense Sequence
auuugaugcugccuucgugu

SEQ ID NO: 849 - RNA, 20 nt, artificial sequence
  siRNA Antisense Sequence
auaauuugaugcugccuucg

SEQ ID NO: 850 - RNA, 20 nt, artificial sequence
  siRNA Antisense Sequence
gauaauuugaugcugccuuc

SEQ ID NO: 851 - RNA, 20 nt, artificial sequence
  siRNA Antisense Sequence
cagauaauuugaugcugccu

SEQ ID NO: 852 - RNA, 20 nt, artificial sequence
  siRNA Antisense Sequence
ccagauaauuugaugcugcc

SEQ ID NO: 853 - RNA, 20 nt, artificial sequence
  siRNA Antisense Sequence
uccagauaauuugaugcugc

SEQ ID NO: 854 - RNA, 20 nt, artificial sequence
  siRNA Antisense Sequence
accaugccugggugaaaauc

SEQ ID NO: 855 - RNA, 20 nt, artificial sequence
  siRNA Antisense Sequence
ggauuacaggugugagccac

SEQ ID NO: 856 - RNA, 20 nt, artificial sequence
  siRNA Antisense Sequence
gggauuacaggugugagcca

SEQ ID NO: 857 - RNA, 20 nt, artificial sequence
  siRNA Antisense Sequence
ugggauuacaggugugagcc

SEQ ID NO: 858 - RNA, 20 nt, artificial sequence
  siRNA Antisense Sequence
uugggauuacaggugugagc

SEQ ID NO: 859 - RNA, 20 nt, artificial sequence
  siRNA Antisense Sequence
cuugggauuacaggugugag

SEQ ID NO: 860 - RNA, 20 nt, artificial sequence
  siRNA Antisense Sequence
acuugggauuacagguguga

SEQ ID NO: 861 - RNA, 20 nt, artificial sequence
  siRNA Antisense Sequence
aacuugggauuacaggugug

SEQ ID NO: 862 - RNA, 20 nt, artificial sequence
  siRNA Antisense Sequence
aaacuugggauuacaggugu

SEQ ID NO: 863 - RNA, 20 nt, artificial sequence
  siRNA Antisense Sequence
aaaacuugggauuacaggug

SEQ ID NO: 864 - RNA, 20 nt, artificial sequence
  siRNA Antisense Sequence
ccucaggugauuguuccgcc

SEQ ID NO: 865 - RNA, 20 nt, artificial sequence
  siRNA Antisense Sequence
accucaggugauuguuccgc

SEQ ID NO: 866 - RNA, 20 nt, artificial sequence
  siRNA Antisense Sequence
gaccucaggugauuguuccg

SEQ ID NO: 867 - RNA, 20 nt, artificial sequence
  siRNA Antisense Sequence
ugaccucaggugauuguucc

SEQ ID NO: 868 - RNA, 20 nt, artificial sequence
  siRNA Antisense Sequence
cugaccucaggugauuguuc

SEQ ID NO: 869 - RNA, 20 nt, artificial sequence
  siRNA Antisense Sequence
caggcuggucucaaaguccu

SEQ ID NO: 870 - RNA, 20 nt, artificial sequence
  siRNA Antisense Sequence
ccaggcuggucucaaagucc

SEQ ID NO: 871 - RNA, 20 nt, artificial sequence
  siRNA Antisense Sequence
gccaggcuggucucaaaguc

SEQ ID NO: 872 - RNA, 20 nt, artificial sequence
  siRNA Antisense Sequence
ggccaggcuggucucaaagu

SEQ ID NO: 873 - RNA, 20 nt, artificial sequence
  siRNA Antisense Sequence
aguagcugggaccagagugc

SEQ ID NO: 874 - RNA, 20 nt, artificial sequence
  siRNA Antisense Sequence
uuccagugauucuccugccu

SEQ ID NO: 875 - RNA, 20 nt, artificial sequence
  siRNA Antisense Sequence
guuccagugauucuccugcc

SEQ ID NO: 876 - RNA, 20 nt, artificial sequence
  siRNA Antisense Sequence
aaccuccaccuccugaguuc

SEQ ID NO: 877 - RNA, 20 nt, artificial sequence
  siRNA Antisense Sequence
caaccuccaccuccugaguu

SEQ ID NO: 878 - RNA, 20 nt, artificial sequence
  siRNA Antisense Sequence
gcaaccuccaccuccugagu

SEQ ID NO: 879 - RNA, 20 nt, artificial sequence
  siRNA Antisense Sequence
ugcaaccuccaccuccugag

SEQ ID NO: 880 - RNA, 20 nt, artificial sequence
  siRNA Antisense Sequence
cugcaaccuccaccuccuga

SEQ ID NO: 881 - RNA, 20 nt, artificial sequence
  siRNA Antisense Sequence
acugcaaccuccaccuccug

SEQ ID NO: 882 - RNA, 20 nt, artificial sequence
  siRNA Antisense Sequence
cacugcaaccuccaccuccu

SEQ ID NO: 883 - RNA, 20 nt, artificial sequence
  siRNA Antisense Sequence
ucacugcaaccuccaccucc

SEQ ID NO: 884 - RNA, 20 nt, artificial sequence
  siRNA Antisense Sequence
cucacugcaaccuccaccuc

SEQ ID NO: 885 - RNA, 20 nt, artificial sequence
  siRNA Antisense Sequence
gcucacugcaaccuccaccu

SEQ ID NO: 886 - RNA, 20 nt, artificial sequence
  siRNA Antisense Sequence
ucggcucacugcaaccucca

SEQ ID NO: 887 - RNA, 20 nt, artificial sequence
  siRNA Antisense Sequence
ucucggcucacugcaaccuc

SEQ ID NO: 888 - RNA, 20 nt, artificial sequence
  siRNA Antisense Sequence
aucucggcucacugcaaccu

SEQ ID NO: 889 - RNA, 20 nt, artificial sequence
  siRNA Antisense Sequence
aaucucggcucacugcaacc

SEQ ID NO: 890 - RNA, 20 nt, artificial sequence
  siRNA Antisense Sequence
caaucucggcucacugcaac

SEQ ID NO: 891 - RNA, 20 nt, artificial sequence
  siRNA Antisense Sequence
gcaaucucggcucacugcaa

SEQ ID NO: 892 - RNA, 20 nt, artificial sequence
  siRNA Antisense Sequence
gugcaaucucggcucacugc

SEQ ID NO: 893 - RNA, 20 nt, artificial sequence
  siRNA Antisense Sequence
ggugcaaucucggcucacug

SEQ ID NO: 894 - RNA, 20 nt, artificial sequence
  siRNA Antisense Sequence
uggugcaaucucggcucacu

SEQ ID NO: 895 - RNA, 20 nt, artificial sequence
  siRNA Antisense Sequence
guggugcaaucucggcucac

SEQ ID NO: 896 - RNA, 20 nt, artificial sequence
  siRNA Antisense Sequence
aguggugcaaucucggcuca

SEQ ID NO: 897 - RNA, 20 nt, artificial sequence
  siRNA Antisense Sequence
caguggugcaaucucggcuc

SEQ ID NO: 898 - RNA, 20 nt, artificial sequence
  siRNA Antisense Sequence
acaguggugcaaucucggcu

SEQ ID NO: 899 - RNA, 20 nt, artificial sequence
  siRNA Antisense Sequence
uacaguggugcaaucucggc

SEQ ID NO: 900 - RNA, 20 nt, artificial sequence
  siRNA Antisense Sequence
guacaguggugcaaucucgg

SEQ ID NO: 901 - RNA, 20 nt, artificial sequence
  siRNA Antisense Sequence
aguacaguggugcaaucucg

SEQ ID NO: 902 - RNA, 20 nt, artificial sequence
  siRNA Antisense Sequence
gaguacaguggugcaaucuc

SEQ ID NO: 903 - RNA, 20 nt, artificial sequence
  siRNA Antisense Sequence
ugcccaggcuagaguacagu

SEQ ID NO: 904 - RNA, 20 nt, artificial sequence
  siRNA Antisense Sequence
uugcccaggcuagaguacag

SEQ ID NO: 905 - RNA, 20 nt, artificial sequence
  siRNA Antisense Sequence
agaacgaugcaaauugggcc

SEQ ID NO: 906 - RNA, 20 nt, artificial sequence
  siRNA Antisense Sequence
aagaacgaugcaaauugggc

SEQ ID NO: 907 - RNA, 20 nt, artificial sequence
  siRNA Antisense Sequence
gaagaacgaugcaaauuggg

SEQ ID NO: 908 - RNA, 20 nt, artificial sequence
  siRNA Antisense Sequence
ggaagaacgaugcaaauugg

SEQ ID NO: 909 - RNA, 20 nt, artificial sequence
  siRNA Antisense Sequence
uggaagaacgaugcaaauug

SEQ ID NO: 910 - RNA, 20 nt, artificial sequence
  siRNA Antisense Sequence
cuggaagaacgaugcaaauu

SEQ ID NO: 911 - RNA, 20 nt, artificial sequence
  siRNA Antisense Sequence
ucuggaagaacgaugcaaau

SEQ ID NO: 912 - RNA, 20 nt, artificial sequence
  siRNA Antisense Sequence
cucuggaagaacgaugcaaa

SEQ ID NO: 913 - RNA, 20 nt, artificial sequence
  siRNA Antisense Sequence
gcucuggaagaacgaugcaa

SEQ ID NO: 914 - RNA, 20 nt, artificial sequence
  siRNA Antisense Sequence
ugcucuggaagaacgaugca

SEQ ID NO: 915 - RNA, 20 nt, artificial sequence
  siRNA Antisense Sequence
uugcucuggaagaacgaugc

SEQ ID NO: 916 - RNA, 20 nt, artificial sequence
  siRNA Antisense Sequence
gcauugcucuggaagaacga

SEQ ID NO: 917 - RNA, 20 nt, artificial sequence
  siRNA Antisense Sequence
ugcauugcucuggaagaacg

SEQ ID NO: 918 - RNA, 20 nt, artificial sequence
  siRNA Antisense Sequence
gugcauugcucuggaagaac

SEQ ID NO: 919 - RNA, 20 nt, artificial sequence
  siRNA Antisense Sequence
uggguggugcauugcucugg

SEQ ID NO: 920 - RNA, 20 nt, artificial sequence
  siRNA Antisense Sequence
agucacacuggcucacucgg

SEQ ID NO: 921 - RNA, 20 nt, artificial sequence
  siRNA Antisense Sequence
ugcacucccgcagucacacu

SEQ ID NO: 922 - RNA, 20 nt, artificial sequence
  siRNA Antisense Sequence
agagccaguagaugugugca

SEQ ID NO: 923 - RNA, 20 nt, artificial sequence
  siRNA Antisense Sequence
ugcagagccaguagaugugu

SEQ ID NO: 924 - RNA, 20 nt, artificial sequence
  siRNA Antisense Sequence
aaccuguuccugucccugca

SEQ ID NO: 925 - RNA, 20 nt, artificial sequence
  siRNA Antisense Sequence
caaccuguuccugucccugc

SEQ ID NO: 926 - RNA, 20 nt, artificial sequence
  siRNA Antisense Sequence
ccaaccuguuccugucccug

SEQ ID NO: 927 - RNA, 20 nt, artificial sequence
  siRNA Antisense Sequence
cccaaccuguuccugucccu

SEQ ID NO: 928 - RNA, 20 nt, artificial sequence
  siRNA Antisense Sequence
aagagggcaggcuucccaac

SEQ ID NO: 929 - RNA, 20 nt, artificial sequence
  siRNA Antisense Sequence
aggagcaagagggcaggcuu

SEQ ID NO: 930 - RNA, 20 nt, artificial sequence
  siRNA Antisense Sequence
cagaaggcaggagcaagagg

SEQ ID NO: 931 - RNA, 20 nt, artificial sequence
  siRNA Antisense Sequence
cucuggugagggacuugcag

SEQ ID NO: 932 - RNA, 20 nt, artificial sequence
  siRNA Antisense Sequence
acucuggugagggacuugca

SEQ ID NO: 933 - RNA, 20 nt, artificial sequence
  siRNA Antisense Sequence
uacucuggugagggacuugc

SEQ ID NO: 934 - RNA, 20 nt, artificial sequence
  siRNA Antisense Sequence
auacucuggugagggacuug

SEQ ID NO: 935 - RNA, 20 nt, artificial sequence
  siRNA Antisense Sequence
gggauacucuggugagggac

SEQ ID NO: 936 - RNA, 20 nt, artificial sequence
  siRNA Antisense Sequence
cagaacaccugaagcagagg

SEQ ID NO: 937 - RNA, 20 nt, artificial sequence
  siRNA Antisense Sequence
ccgccugaagucuccauguc

SEQ ID NO: 938 - RNA, 20 nt, artificial sequence
  siRNA Antisense Sequence
uccgccugaagucuccaugu

SEQ ID NO: 939 - RNA, 20 nt, artificial sequence
  siRNA Antisense Sequence
cuccgccugaagucuccaug

SEQ ID NO: 940 - RNA, 20 nt, artificial sequence
  siRNA Antisense Sequence
ccuccgccugaagucuccau

SEQ ID NO: 941 - RNA, 20 nt, artificial sequence
  siRNA Antisense Sequence
agaaggagacaaggccacuu

SEQ ID NO: 942 - RNA, 20 nt, artificial sequence
  siRNA Antisense Sequence
uagaaggagacaaggccacu

SEQ ID NO: 943 - RNA, 20 nt, artificial sequence
  siRNA Antisense Sequence
ucccgguagaaggagacaag

SEQ ID NO: 944 - RNA, 20 nt, artificial sequence
  siRNA Antisense Sequence
gucccgguagaaggagacaa

SEQ ID NO: 945 - RNA, 20 nt, artificial sequence
  siRNA Antisense Sequence
agucccgguagaaggagaca

SEQ ID NO: 946 - RNA, 20 nt, artificial sequence
  siRNA Antisense Sequence
cagucccgguagaaggagac

SEQ ID NO: 947 - RNA, 20 nt, artificial sequence
  siRNA Antisense Sequence
ccagucccgguagaaggaga

SEQ ID NO: 948 - RNA, 20 nt, artificial sequence
  siRNA Antisense Sequence
uccagucccgguagaaggag

SEQ ID NO: 949 - RNA, 20 nt, artificial sequence
  siRNA Antisense Sequence
uuccagucccgguagaagga

SEQ ID NO: 950 - RNA, 20 nt, artificial sequence
  siRNA Antisense Sequence
ugcuuccagucccgguagaa

SEQ ID NO: 951 - RNA, 20 nt, artificial sequence
  siRNA Antisense Sequence
cugcuuccagucccgguaga

SEQ ID NO: 952 - RNA, 20 nt, artificial sequence
  siRNA Antisense Sequence
ccugcuuguacugcuuccag

SEQ ID NO: 953 - RNA, 20 nt, artificial sequence
  siRNA Antisense Sequence
cccugcuuguacugcuucca

SEQ ID NO: 954 - RNA, 20 nt, artificial sequence
  siRNA Antisense Sequence
gaugcugccaaagcccugcu

SEQ ID NO: 955 - RNA, 20 nt, artificial sequence
  siRNA Antisense Sequence
acggaugcugccaaagcccu

SEQ ID NO: 956 - RNA, 20 nt, artificial sequence
  siRNA Antisense Sequence
cgguggauguguucguuccc

SEQ ID NO: 957 - RNA, 20 nt, artificial sequence
  siRNA Antisense Sequence
ccgguggauguguucguucc

SEQ ID NO: 958 - RNA, 20 nt, artificial sequence
  siRNA Antisense Sequence
gccgguggauguguucguuc

SEQ ID NO: 959 - RNA, 20 nt, artificial sequence
  siRNA Antisense Sequence
agccgguggauguguucguu

SEQ ID NO: 960 - RNA, 20 nt, artificial sequence
  siRNA Antisense Sequence
gagccgguggauguguucgu

SEQ ID NO: 961 - RNA, 20 nt, artificial sequence
  siRNA Antisense Sequence
agagccgguggauguguucg

SEQ ID NO: 962 - RNA, 20 nt, artificial sequence
  siRNA Antisense Sequence
gagagccgguggauguguuc

SEQ ID NO: 963 - RNA, 20 nt, artificial sequence
  siRNA Antisense Sequence
ggagagccgguggauguguu

SEQ ID NO: 964 - RNA, 20 nt, artificial sequence
  siRNA Antisense Sequence
uggagagccgguggaugugu

SEQ ID NO: 965 - RNA, 20 nt, artificial sequence
  siRNA Antisense Sequence
ucuggagagccgguggaugu

SEQ ID NO: 966 - RNA, 20 nt, artificial sequence
  siRNA Antisense Sequence
ugucuggagagccgguggau

SEQ ID NO: 967 - RNA, 20 nt, artificial sequence
  siRNA Antisense Sequence
ugugcuuaccuccaucucua

SEQ ID NO: 968 - RNA, 20 nt, artificial sequence
  siRNA Antisense Sequence
uugugcuuaccuccaucucu

SEQ ID NO: 969 - RNA, 20 nt, artificial sequence
  siRNA Antisense Sequence
ccggaguuguacgcggucau

SEQ ID NO: 970 - RNA, 20 nt, artificial sequence
  siRNA Antisense Sequence
ucagaauaggaauggcaccc

SEQ ID NO: 971 - RNA, 20 nt, artificial sequence
  siRNA Antisense Sequence
aucagaauaggaauggcacc

SEQ ID NO: 972 - RNA, 20 nt, artificial sequence
  siRNA Antisense Sequence
aaucagaauaggaauggcac

SEQ ID NO: 973 - RNA, 20 nt, artificial sequence
  siRNA Antisense Sequence
gaaucagaauaggaauggca

SEQ ID NO: 974 - RNA, 20 nt, artificial sequence
  siRNA Antisense Sequence
gcaggaaaaccaucacaaug

SEQ ID NO: 975 - RNA, 20 nt, artificial sequence
  siRNA Antisense Sequence
ugcaggaaaaccaucacaau

SEQ ID NO: 976 - RNA, 20 nt, artificial sequence
  siRNA Antisense Sequence
uugcaggaaaaccaucacaa

SEQ ID NO: 977 - RNA, 20 nt, artificial sequence
  siRNA Antisense Sequence
uuacaacuugcaggaaaacc

SEQ ID NO: 978 - RNA, 20 nt, artificial sequence
  siRNA Antisense Sequence
cuccauuacaacuugcagga

SEQ ID NO: 979 - RNA, 20 nt, artificial sequence
  siRNA Antisense Sequence
acuccauuacaacuugcagg

SEQ ID NO: 980 - RNA, 20 nt, artificial sequence
  siRNA Antisense Sequence
aacuccauuacaacuugcag

SEQ ID NO: 981 - RNA, 20 nt, artificial sequence
  siRNA Antisense Sequence
caacuccauuacaacuugca

SEQ ID NO: 982 - RNA, 20 nt, artificial sequence
  siRNA Antisense Sequence
ccucaacuccauuacaacuu

SEQ ID NO: 983 - RNA, 20 nt, artificial sequence
  siRNA Antisense Sequence
uccucaacuccauuacaacu

SEQ ID NO: 984 - RNA, 20 nt, artificial sequence
  siRNA Antisense Sequence
uuccucaacuccauuacaac

SEQ ID NO: 985 - RNA, 20 nt, artificial sequence
  siRNA Antisense Sequence
ucuacucuggccugggucug

SEQ ID NO: 986 - RNA, 20 nt, artificial sequence
  siRNA Antisense Sequence
ugaauuugcucuacucuggc

SEQ ID NO: 987 - RNA, 20 nt, artificial sequence
  siRNA Antisense Sequence
uugaauuugcucuacucugg

SEQ ID NO: 988 - RNA, 20 nt, artificial sequence
  siRNA Antisense Sequence
guugaauuugcucuacucug

SEQ ID NO: 989 - RNA, 20 nt, artificial sequence
  siRNA Antisense Sequence
ucggccagagcagagacuag

SEQ ID NO: 990 - RNA, 20 nt, artificial sequence
  siRNA Antisense Sequence
cucggccagagcagagacua

SEQ ID NO: 991 - RNA, 20 nt, artificial sequence
  siRNA Antisense Sequence
aaggaccucaugcucggcca

SEQ ID NO: 992 - RNA, 20 nt, artificial sequence
  siRNA Antisense Sequence
aaaggaccucaugcucggcc

SEQ ID NO: 993 - RNA, 20 nt, artificial sequence
  siRNA Antisense Sequence
uaaaggaccucaugcucggc

SEQ ID NO: 994 - RNA, 20 nt, artificial sequence
  siRNA Antisense Sequence
cuaaaggaccucaugcucgg

SEQ ID NO: 995 - RNA, 20 nt, artificial sequence
  siRNA Antisense Sequence
ccuaaaggaccucaugcucg

SEQ ID NO: 996 - RNA, 20 nt, artificial sequence
  siRNA Antisense Sequence
accuaaaggaccucaugcuc

SEQ ID NO: 997 - RNA, 20 nt, artificial sequence
  siRNA Antisense Sequence
caccuaaaggaccucaugcu

SEQ ID NO: 998 - RNA, 20 nt, artificial sequence
  siRNA Antisense Sequence
gcaccuaaaggaccucaugc

SEQ ID NO: 999 - RNA, 20 nt, artificial sequence
  siRNA Antisense Sequence
ugcaccuaaaggaccucaug

SEQ ID NO: 1000 - RNA, 20 nt, artificial sequence
  siRNA Antisense Sequence
uugcaccuaaaggaccucau

SEQ ID NO: 1001 - RNA, 20 nt, artificial sequence
  siRNA Antisense Sequence
auuugcaccuaaaggaccuc

SEQ ID NO: 1002 - RNA, 20 nt, artificial sequence
  siRNA Antisense Sequence
gauuugcaccuaaaggaccu

SEQ ID NO: 1003 - RNA, 20 nt, artificial sequence
  siRNA Antisense Sequence
agauuugcaccuaaaggacc

SEQ ID NO: 1004 - RNA, 20 nt, artificial sequence
  siRNA Antisense Sequence
aagauuugcaccuaaaggac

SEQ ID NO: 1005 - RNA, 20 nt, artificial sequence
  siRNA Antisense Sequence
guaagauuugcaccuaaagg

SEQ ID NO: 1006 - RNA, 20 nt, artificial sequence
  siRNA Antisense Sequence
gugagugcuuucagaccuuc

SEQ ID NO: 1007 - RNA, 20 nt, artificial sequence
  siRNA Antisense Sequence
agugagugcuuucagaccuu

SEQ ID NO: 1008 - RNA, 20 nt, artificial sequence
  siRNA Antisense Sequence
uagugagugcuuucagaccu

SEQ ID NO: 1009 - RNA, 20 nt, artificial sequence
  siRNA Antisense Sequence
uauagugagugcuuucagac

SEQ ID NO: 1010 - RNA, 20 nt, artificial sequence
  siRNA Antisense Sequence
gauauagugagugcuuucag

SEQ ID NO: 1011 - RNA, 20 nt, artificial sequence
  siRNA Antisense Sequence
aggauauagugagugcuuuc

SEQ ID NO: 1012 - RNA, 20 nt, artificial sequence
  siRNA Antisense Sequence
gaggauauagugagugcuuu

SEQ ID NO: 1013 - RNA, 20 nt, artificial sequence
  siRNA Antisense Sequence
agagcugcuguaagagaaac

SEQ ID NO: 1014 - RNA, 20 nt, artificial sequence
  siRNA Antisense Sequence
cagagcugcuguaagagaaa

SEQ ID NO: 1015 - RNA, 20 nt, artificial sequence
  siRNA Antisense Sequence
gaaucccacacagagcugcu

SEQ ID NO: 1016 - RNA, 20 nt, artificial sequence
  siRNA Antisense Sequence
cuauauuccucacuuuccug

SEQ ID NO: 1017 - RNA, 20 nt, artificial sequence
  siRNA Antisense Sequence
ggccuugauuagucucucuu

SEQ ID NO: 1018 - RNA, 20 nt, artificial sequence
  siRNA Antisense Sequence
uggccuugauuagucucucu

SEQ ID NO: 1019 - RNA, 20 nt, artificial sequence
  siRNA Antisense Sequence
auggccuugauuagucucuc

SEQ ID NO: 1020 - RNA, 20 nt, artificial sequence
  siRNA Antisense Sequence
uauggccuugauuagucucu

SEQ ID NO: 1021 - RNA, 20 nt, artificial sequence
  siRNA Antisense Sequence
auauggccuugauuagucuc

SEQ ID NO: 1022 - RNA, 20 nt, artificial sequence
  siRNA Antisense Sequence
gaacuucuuuccugauucac

SEQ ID NO: 1023 - RNA, 20 nt, artificial sequence
  siRNA Antisense Sequence
ucgaacuucuuuccugauuc

SEQ ID NO: 1024 - RNA, 20 nt, artificial sequence
  siRNA Antisense Sequence
cucgaacuucuuuccugauu

SEQ ID NO: 1025 - RNA, 20 nt, artificial sequence
  siRNA Antisense Sequence
gcucgaacuucuuuccugau

SEQ ID NO: 1026 - RNA, 20 nt, artificial sequence
  siRNA Antisense Sequence
ggcucgaacuucuuuccuga

SEQ ID NO: 1027 - RNA, 20 nt, artificial sequence
  siRNA Antisense Sequence
aggcucgaacuucuuuccug

SEQ ID NO: 1028 - RNA, 20 nt, artificial sequence
  siRNA Antisense Sequence
aaggcucgaacuucuuuccu

SEQ ID NO: 1029 - RNA, 20 nt, artificial sequence
  siRNA Antisense Sequence
caaggcucgaacuucuuucc

SEQ ID NO: 1030 - RNA, 20 nt, artificial sequence
  siRNA Antisense Sequence
acaaggcucgaacuucuuuc

SEQ ID NO: 1031 - RNA, 20 nt, artificial sequence
  siRNA Antisense Sequence
aacaaggcucgaacuucuuu

SEQ ID NO: 1032 - RNA, 20 nt, artificial sequence
  siRNA Antisense Sequence
aaacaaggcucgaacuucuu

SEQ ID NO: 1033 - RNA, 20 nt, artificial sequence
  siRNA Antisense Sequence
aaaacaaggcucgaacuucu

SEQ ID NO: 1034 - RNA, 20 nt, artificial sequence
  siRNA Antisense Sequence
gaaaacaaggcucgaacuuc

SEQ ID NO: 1035 - RNA, 20 nt, artificial sequence
  siRNA Antisense Sequence
agaaaacaaggcucgaacuu

SEQ ID NO: 1036 - RNA, 20 nt, artificial sequence
  siRNA Antisense Sequence
aaucagaaaacaaggcucga

SEQ ID NO: 1037 - RNA, 20 nt, artificial sequence
  siRNA Antisense Sequence
ccugggaaucagaaaacaag

SEQ ID NO: 1038 - RNA, 20 nt, artificial sequence
  siRNA Antisense Sequence
accuccaguuuacuguguua

SEQ ID NO: 1039 - RNA, 20 nt, artificial sequence
  siRNA Antisense Sequence
uuaccuccaguuuacugugu

SEQ ID NO: 1040 - RNA, 20 nt, artificial sequence
  siRNA Antisense Sequence
guuuaccuccaguuuacugu

SEQ ID NO: 1041 - RNA, 20 nt, artificial sequence
  siRNA Antisense Sequence
uguuuaccuccaguuuacug

SEQ ID NO: 1042 - RNA, 20 nt, artificial sequence
  siRNA Antisense Sequence
cuuguuuaccuccaguuuac

SEQ ID NO: 1043 - RNA, 20 nt, artificial sequence
  siRNA Antisense Sequence
agucccauagccaaacaucu

SEQ ID NO: 1044 - RNA, 20 nt, artificial sequence
  siRNA Antisense Sequence
cagucccauagccaaacauc

SEQ ID NO: 1045 - RNA, 20 nt, artificial sequence
  siRNA Antisense Sequence
acagucccauagccaaacau

SEQ ID NO: 1046 - RNA, 20 nt, artificial sequence
  siRNA Antisense Sequence
gacagucccauagccaaaca

SEQ ID NO: 1047 - RNA, 20 nt, artificial sequence
  siRNA Antisense Sequence
ugacagucccauagccaaac

SEQ ID NO: 1048 - RNA, 20 nt, artificial sequence
  siRNA Antisense Sequence
cugacagucccauagccaaa

SEQ ID NO: 1049 - RNA, 20 nt, artificial sequence
  siRNA Antisense Sequence
ccugacagucccauagccaa

SEQ ID NO: 1050 - RNA, 20 nt, artificial sequence
  siRNA Antisense Sequence
ucuccugacagucccauagc

SEQ ID NO: 1051 - RNA, 20 nt, artificial sequence
  siRNA Antisense Sequence
cucuccugacagucccauag

SEQ ID NO: 1052 - RNA, 20 nt, artificial sequence
  siRNA Antisense Sequence
ucucuccugacagucccaua

SEQ ID NO: 1053 - RNA, 20 nt, artificial sequence
  siRNA Antisense Sequence
ccuucucuccugacaguccc

SEQ ID NO: 1054 - RNA, 20 nt, artificial sequence
  siRNA Antisense Sequence
ggcuccauuucaugcugucu

SEQ ID NO: 1055 - RNA, 20 nt, artificial sequence
  siRNA Antisense Sequence
aggcuccauuucaugcuguc

SEQ ID NO: 1056 - RNA, 20 nt, artificial sequence
  siRNA Antisense Sequence
gcaggcuccauuucaugcug

SEQ ID NO: 1057 - RNA, 20 nt, artificial sequence
  siRNA Antisense Sequence
gcagcaggcuccauuucaug

SEQ ID NO: 1058 - RNA, 20 nt, artificial sequence
  siRNA Antisense Sequence
aagugcagcaggcuccauuu

SEQ ID NO: 1059 - RNA, 20 nt, artificial sequence
  siRNA Antisense Sequence
aaagugcagcaggcuccauu

SEQ ID NO: 1060 - RNA, 20 nt, artificial sequence
  siRNA Antisense Sequence
gaaagugcagcaggcuccau

SEQ ID NO: 1061 - RNA, 20 nt, artificial sequence
  siRNA Antisense Sequence
agaaagugcagcaggcucca

SEQ ID NO: 1062 - RNA, 20 nt, artificial sequence
  siRNA Antisense Sequence
aagaaagugcagcaggcucc

SEQ ID NO: 1063 - RNA, 20 nt, artificial sequence
  siRNA Antisense Sequence
uaaagaaagugcagcaggcu

SEQ ID NO: 1064 - RNA, 20 nt, artificial sequence
  siRNA Antisense Sequence
uuaaagaaagugcagcaggc

SEQ ID NO: 1065 - RNA, 20 nt, artificial sequence
  siRNA Antisense Sequence
cuuaaagaaagugcagcagg

SEQ ID NO: 1066 - RNA, 20 nt, artificial sequence
  siRNA Antisense Sequence
gccuuaaagaaagugcagca

SEQ ID NO: 1067 - RNA, 20 nt, artificial sequence
  siRNA Antisense Sequence
agccuuaaagaaagugcagc

SEQ ID NO: 1068 - RNA, 20 nt, artificial sequence
  siRNA Antisense Sequence
agcagagccuuaaagaaagu

SEQ ID NO: 1069 - RNA, 20 nt, artificial sequence
  siRNA Antisense Sequence
gagcagagccuuaaagaaag

SEQ ID NO: 1070 - RNA, 20 nt, artificial sequence
  siRNA Antisense Sequence
aggagcagagccuuaaagaa

SEQ ID NO: 1071 - RNA, 20 nt, artificial sequence
  siRNA Antisense Sequence
gaggagcagagccuuaaaga

SEQ ID NO: 1072 - RNA, 20 nt, artificial sequence
  siRNA Antisense Sequence
aggaggagcagagccuuaaa

SEQ ID NO: 1073 - RNA, 20 nt, artificial sequence
  siRNA Antisense Sequence
ucaggaggagcagagccuua

SEQ ID NO: 1074 - RNA, 20 nt, artificial sequence
  siRNA Antisense Sequence
uugcccucccaguccuguca

SEQ ID NO: 1075 - RNA, 20 nt, artificial sequence
  siRNA Antisense Sequence
acucagcguagcgcagguug

SEQ ID NO: 1076 - RNA, 20 nt, artificial sequence
  siRNA Antisense Sequence
uacucagcguagcgcagguu

SEQ ID NO: 1077 - RNA, 20 nt, artificial sequence
  siRNA Antisense Sequence
uauacucagcguagcgcagg

SEQ ID NO: 1078 - RNA, 20 nt, artificial sequence
  siRNA Antisense Sequence
cuauacucagcguagcgcag

SEQ ID NO: 1079 - RNA, 20 nt, artificial sequence
  siRNA Antisense Sequence
acaaaguggcuauacucagc

SEQ ID NO: 1080 - RNA, 20 nt, artificial sequence
  siRNA Antisense Sequence
aacaaaguggcuauacucag

SEQ ID NO: 1081 - RNA, 20 nt, artificial sequence
  siRNA Antisense Sequence
cauugcccaaaacaaagugg

SEQ ID NO: 1082 - RNA, 20 nt, artificial sequence
  siRNA Antisense Sequence
guugaguucauugcccaaaa

SEQ ID NO: 1083 - RNA, 20 nt, artificial sequence
  siRNA Antisense Sequence
uguugaguucauugcccaaa

SEQ ID NO: 1084 - RNA, 20 nt, artificial sequence
  siRNA Antisense Sequence
cuguugaguucauugcccaa

SEQ ID NO: 1085 - RNA, 20 nt, artificial sequence
  siRNA Antisense Sequence
gcuguugaguucauugccca

SEQ ID NO: 1086 - RNA, 20 nt, artificial sequence
  siRNA Antisense Sequence
cgauagcuguugaguucauu

SEQ ID NO: 1087 - RNA, 20 nt, artificial sequence
  siRNA Antisense Sequence
ggcgauagcuguugaguuca

SEQ ID NO: 1088 - RNA, 20 nt, artificial sequence
  siRNA Antisense Sequence
aggcgauagcuguugaguuc

SEQ ID NO: 1089 - RNA, 20 nt, artificial sequence
  siRNA Antisense Sequence
gaggcgauagcuguugaguu

SEQ ID NO: 1090 - RNA, 20 nt, artificial sequence
  siRNA Antisense Sequence
agaggcgauagcuguugagu

SEQ ID NO: 1091 - RNA, 20 nt, artificial sequence
  siRNA Antisense Sequence
aagaggcgauagcuguugag

SEQ ID NO: 1092 - RNA, 20 nt, artificial sequence
  siRNA Antisense Sequence
gaagaggcgauagcuguuga

SEQ ID NO: 1093 - RNA, 20 nt, artificial sequence
  siRNA Antisense Sequence
ggaagaggcgauagcuguug

SEQ ID NO: 1094 - RNA, 20 nt, artificial sequence
  siRNA Antisense Sequence
aggaagaggcgauagcuguu

SEQ ID NO: 1095 - RNA, 20 nt, artificial sequence
  siRNA Antisense Sequence
caggaagaggcgauagcugu

SEQ ID NO: 1096 - RNA, 20 nt, artificial sequence
  siRNA Antisense Sequence
ccaggaagaggcgauagcug

SEQ ID NO: 1097 - RNA, 20 nt, artificial sequence
  siRNA Antisense Sequence
cccaggaagaggcgauagcu

SEQ ID NO: 1098 - RNA, 20 nt, artificial sequence
  siRNA Antisense Sequence
acauugccaguguaguuccc

SEQ ID NO: 1099 - RNA, 20 nt, artificial sequence
  siRNA Antisense Sequence
cacauugccaguguaguucc

SEQ ID NO: 1100 - RNA, 20 nt, artificial sequence
  siRNA Antisense Sequence
ccacauugccaguguaguuc

SEQ ID NO: 1101 - RNA, 20 nt, artificial sequence
  siRNA Antisense Sequence
cccacauugccaguguaguu

SEQ ID NO: 1102 - RNA, 20 nt, artificial sequence
  siRNA Antisense Sequence
auacuggagggcgucguucc

SEQ ID NO: 1103 - RNA, 20 nt, artificial sequence
  siRNA Antisense Sequence
gauacuggagggcgucguuc

SEQ ID NO: 1104 - RNA, 20 nt, artificial sequence
  siRNA Antisense Sequence
ugauacuggagggcgucguu

SEQ ID NO: 1105 - RNA, 20 nt, artificial sequence
  siRNA Antisense Sequence
augauacuggagggcgucgu

SEQ ID NO: 1106 - RNA, 20 nt, artificial sequence
  siRNA Antisense Sequence
uaugauacuggagggcgucg

SEQ ID NO: 1107 - RNA, 20 nt, artificial sequence
  siRNA Antisense Sequence
uuguuaugauacuggagggc

SEQ ID NO: 1108 - RNA, 20 nt, artificial sequence
  siRNA Antisense Sequence
guuguuaugauacuggaggg

SEQ ID NO: 1109 - RNA, 20 nt, artificial sequence
  siRNA Antisense Sequence
uguuguuaugauacuggagg

SEQ ID NO: 1110 - RNA, 20 nt, artificial sequence
  siRNA Antisense Sequence
cuguguuguuaugauacugg

SEQ ID NO: 1111 - RNA, 20 nt, artificial sequence
  siRNA Antisense Sequence
gcuguguuguuaugauacug

SEQ ID NO: 1112 - RNA, 20 nt, artificial sequence
  siRNA Antisense Sequence
ggcuguguuguuaugauacu

SEQ ID NO: 1113 - RNA, 20 nt, artificial sequence
  siRNA Antisense Sequence
aggcuguguuguuaugauac

SEQ ID NO: 1114 - RNA, 20 nt, artificial sequence
  siRNA Antisense Sequence
gaaggcuguguuguuaugau

SEQ ID NO: 1115 - RNA, 20 nt, artificial sequence
  siRNA Antisense Sequence
ugaaggcuguguuguuauga

SEQ ID NO: 1116 - RNA, 20 nt, artificial sequence
  siRNA Antisense Sequence
cugaaggcuguguuguuaug

SEQ ID NO: 1117 - RNA, 20 nt, artificial sequence
  siRNA Antisense Sequence
gcugaaggcuguguuguuau

SEQ ID NO: 1118 - RNA, 20 nt, artificial sequence
  siRNA Antisense Sequence
ugcugaaggcuguguuguua

SEQ ID NO: 1119 - RNA, 20 nt, artificial sequence
  siRNA Antisense Sequence
uguccuuguccuuggugcug

SEQ ID NO: 1120 - RNA, 20 nt, artificial sequence
  siRNA Antisense Sequence
uuguccuuguccuuggugcu

SEQ ID NO: 1121 - RNA, 20 nt, artificial sequence
  siRNA Antisense Sequence
gcaguugucauuguccuugu

SEQ ID NO: 1122 - RNA, 20 nt, artificial sequence
  siRNA Antisense Sequence
ccaagcaguugucauugucc

SEQ ID NO: 1123 - RNA, 20 nt, artificial sequence
  siRNA Antisense Sequence
uccaagcaguugucauuguc

SEQ ID NO: 1124 - RNA, 20 nt, artificial sequence
  siRNA Antisense Sequence
uguccaagcaguugucauug

SEQ ID NO: 1125 - RNA, 20 nt, artificial sequence
  siRNA Antisense Sequence
uuguccaagcaguugucauu

SEQ ID NO: 1126 - RNA, 20 nt, artificial sequence
  siRNA Antisense Sequence
cuuguccaagcaguugucau

SEQ ID NO: 1127 - RNA, 20 nt, artificial sequence
  siRNA Antisense Sequence
acuuguccaagcaguuguca

SEQ ID NO: 1128 - RNA, 20 nt, artificial sequence
  siRNA Antisense Sequence
cacuuguccaagcaguuguc

SEQ ID NO: 1129 - RNA, 20 nt, artificial sequence
  siRNA Antisense Sequence
acacuuguccaagcaguugu

SEQ ID NO: 1130 - RNA, 20 nt, artificial sequence
  siRNA Antisense Sequence
cacacuuguccaagcaguug

SEQ ID NO: 1131 - RNA, 20 nt, artificial sequence
  siRNA Antisense Sequence
gcacacuuguccaagcaguu

SEQ ID NO: 1132 - RNA, 20 nt, artificial sequence
  siRNA Antisense Sequence
ugcacacuuguccaagcagu

SEQ ID NO: 1133 - RNA, 20 nt, artificial sequence
  siRNA Antisense Sequence
caccuuugcggagcugugca

SEQ ID NO: 1134 - RNA, 20 nt, artificial sequence
  siRNA Antisense Sequence
ucaccuuugcggagcugugc

SEQ ID NO: 1135 - RNA, 20 nt, artificial sequence
  siRNA Antisense Sequence
cucaccuuugcggagcugug

SEQ ID NO: 1136 - RNA, 20 nt, artificial sequence
  siRNA Antisense Sequence
ucucaccuuugcggagcugu

SEQ ID NO: 1137 - RNA, 20 nt, artificial sequence
  siRNA Antisense Sequence
aucucaccuuugcggagcug

SEQ ID NO: 1138 - RNA, 20 nt, artificial sequence
  siRNA Antisense Sequence
aaucucaccuuugcggagcu

SEQ ID NO: 1139 - RNA, 20 nt, artificial sequence
  siRNA Antisense Sequence
aaaucucaccuuugcggagc

SEQ ID NO: 1140 - RNA, 20 nt, artificial sequence
  siRNA Antisense Sequence
agcuuguaccugaacuucuc

SEQ ID NO: 1141 - RNA, 20 nt, artificial sequence
  siRNA Antisense Sequence
gagcuuguaccugaacuucu

SEQ ID NO: 1142 - RNA, 20 nt, artificial sequence
  siRNA Antisense Sequence
ugagcuuguaccugaacuuc

SEQ ID NO: 1143 - RNA, 20 nt, artificial sequence
  siRNA Antisense Sequence
uaugagcuuguaccugaacu

SEQ ID NO: 1144 - RNA, 20 nt, artificial sequence
  siRNA Antisense Sequence
uuaugagcuuguaccugaac

SEQ ID NO: 1145 - RNA, 20 nt, artificial sequence
  siRNA Antisense Sequence
ggauuaugagcuuguaccug

SEQ ID NO: 1146 - RNA, 20 nt, artificial sequence
  siRNA Antisense Sequence
gggauuaugagcuuguaccu

SEQ ID NO: 1147 - RNA, 20 nt, artificial sequence
  siRNA Antisense Sequence
ugggauuaugagcuuguacc

SEQ ID NO: 1148 - RNA, 20 nt, artificial sequence
  siRNA Antisense Sequence
gugggauuaugagcuuguac

SEQ ID NO: 1149 - RNA, 20 nt, artificial sequence
  siRNA Antisense Sequence
agugggauuaugagcuugua

SEQ ID NO: 1150 - RNA, 20 nt, artificial sequence
  siRNA Antisense Sequence
ucaagugggauuaugagcuu

SEQ ID NO: 1151 - RNA, 20 nt, artificial sequence
  siRNA Antisense Sequence
cucuuucuccucaaguggga

SEQ ID NO: 1152 - RNA, 20 nt, artificial sequence
  siRNA Antisense Sequence
aaccggaauaucaacuguac

SEQ ID NO: 1153 - RNA, 20 nt, artificial sequence
  siRNA Antisense Sequence
caaaaccggaauaucaacug

SEQ ID NO: 1154 - RNA, 20 nt, artificial sequence
  siRNA Antisense Sequence
ccaaaaccggaauaucaacu

SEQ ID NO: 1155 - RNA, 20 nt, artificial sequence
  siRNA Antisense Sequence
accaaaaccggaauaucaac

SEQ ID NO: 1156 - RNA, 20 nt, artificial sequence
  siRNA Antisense Sequence
gaaagaauaccaaaaccgga

SEQ ID NO: 1157 - RNA, 20 nt, artificial sequence
  siRNA Antisense Sequence
gggucagaaagaauaccaaa

SEQ ID NO: 1158 - RNA, 20 nt, artificial sequence
  siRNA Antisense Sequence
agggucagaaagaauaccaa

SEQ ID NO: 1159 - RNA, 20 nt, artificial sequence
  siRNA Antisense Sequence
accagacaucagguaaggag

SEQ ID NO: 1160 - RNA, 20 nt, artificial sequence
  siRNA Antisense Sequence
gaccagacaucagguaagga

SEQ ID NO: 1161 - RNA, 20 nt, artificial sequence
  siRNA Antisense Sequence
agaccagacaucagguaagg

SEQ ID NO: 1162 - RNA, 20 nt, artificial sequence
  siRNA Antisense Sequence
auagaccagacaucagguaa

SEQ ID NO: 1163 - RNA, 20 nt, artificial sequence
  siRNA Antisense Sequence
gauagaccagacaucaggua

SEQ ID NO: 1164 - RNA, 20 nt, artificial sequence
  siRNA Antisense Sequence
acugugauagaccagacauc

SEQ ID NO: 1165 - RNA, 20 nt, artificial sequence
  siRNA Antisense Sequence
gacugugauagaccagacau

SEQ ID NO: 1166 - RNA, 20 nt, artificial sequence
  siRNA Antisense Sequence
ugacugugauagaccagaca

SEQ ID NO: 1167 - RNA, 20 nt, artificial sequence
  siRNA Antisense Sequence
uugacugugauagaccagac

SEQ ID NO: 1168 - RNA, 20 nt, artificial sequence
  siRNA Antisense Sequence
guugacugugauagaccaga

SEQ ID NO: 1169 - RNA, 20 nt, artificial sequence
  siRNA Antisense Sequence
aguugacugugauagaccag

SEQ ID NO: 1170 - RNA, 20 nt, artificial sequence
  siRNA Antisense Sequence
aaguugacugugauagacca

SEQ ID NO: 1171 - RNA, 20 nt, artificial sequence
  siRNA Antisense Sequence
gcuaguaaguugacugugau

SEQ ID NO: 1172 - RNA, 20 nt, artificial sequence
  siRNA Antisense Sequence
ugcuaguaaguugacuguga

SEQ ID NO: 1173 - RNA, 20 nt, artificial sequence
  siRNA Antisense Sequence
gugcuaguaaguugacugug

SEQ ID NO: 1174 - RNA, 20 nt, artificial sequence
  siRNA Antisense Sequence
agugcuaguaaguugacugu

SEQ ID NO: 1175 - RNA, 20 nt, artificial sequence
  siRNA Antisense Sequence
gacccagugcuaguaaguug

SEQ ID NO: 1176 - RNA, 20 nt, artificial sequence
  siRNA Antisense Sequence
agacccagugcuaguaaguu

SEQ ID NO: 1177 - RNA, 20 nt, artificial sequence
  siRNA Antisense Sequence
cagacccagugcuaguaagu

SEQ ID NO: 1178 - RNA, 20 nt, artificial sequence
  siRNA Antisense Sequence
acagacccagugcuaguaag

SEQ ID NO: 1179 - RNA, 20 nt, artificial sequence
  siRNA Antisense Sequence
aacagacccagugcuaguaa

SEQ ID NO: 1180 - RNA, 20 nt, artificial sequence
  siRNA Antisense Sequence
aaacagacccagugcuagua

SEQ ID NO: 1181 - RNA, 20 nt, artificial sequence
  siRNA Antisense Sequence
gaaacagacccagugcuagu

SEQ ID NO: 1182 - RNA, 20 nt, artificial sequence
  siRNA Antisense Sequence
caugagaaacagacccagug

SEQ ID NO: 1183 - RNA, 20 nt, artificial sequence
  siRNA Antisense Sequence
gccaccuggcaugagaaaca

SEQ ID NO: 1184 - RNA, 20 nt, artificial sequence
  siRNA Antisense Sequence
agccaccuggcaugagaaac

SEQ ID NO: 1185 - RNA, 20 nt, artificial sequence
  siRNA Antisense Sequence
uagccaccuggcaugagaaa

SEQ ID NO: 1186 - RNA, 20 nt, artificial sequence
  siRNA Antisense Sequence
aguagccaccuggcaugaga

SEQ ID NO: 1187 - RNA, 20 nt, artificial sequence
  siRNA Antisense Sequence
caguagccaccuggcaugag

SEQ ID NO: 1188 - RNA, 20 nt, artificial sequence
  siRNA Antisense Sequence
guuguaccaguagccaccug

SEQ ID NO: 1189 - RNA, 20 nt, artificial sequence
  siRNA Antisense Sequence
aguuguaccaguagccaccu

SEQ ID NO: 1190 - RNA, 20 nt, artificial sequence
  siRNA Antisense Sequence
cagcaguuguaccaguagcc

SEQ ID NO: 1191 - RNA, 20 nt, artificial sequence
  siRNA Antisense Sequence
gcagcaguuguaccaguagc

SEQ ID NO: 1192 - RNA, 20 nt, artificial sequence
  siRNA Antisense Sequence
gugcagcaguuguaccagua

SEQ ID NO: 1193 - RNA, 20 nt, artificial sequence
  siRNA Antisense Sequence
ugugcagcaguuguaccagu

SEQ ID NO: 1194 - RNA, 20 nt, artificial sequence
  siRNA Antisense Sequence
cugugcagcaguuguaccag

SEQ ID NO: 1195 - RNA, 20 nt, artificial sequence
  siRNA Antisense Sequence
ucugugcagcaguuguacca

SEQ ID NO: 1196 - RNA, 20 nt, artificial sequence
  siRNA Antisense Sequence
gucugugcagcaguuguacc

SEQ ID NO: 1197 - RNA, 20 nt, artificial sequence
  siRNA Antisense Sequence
agucugugcagcaguuguac

SEQ ID NO: 1198 - RNA, 20 nt, artificial sequence
  siRNA Antisense Sequence
gagucugugcagcaguugua

SEQ ID NO: 1199 - RNA, 20 nt, artificial sequence
  siRNA Antisense Sequence
ggagucugugcagcaguugu

SEQ ID NO: 1200 - RNA, 20 nt, artificial sequence
  siRNA Antisense Sequence
uuggagucugugcagcaguu

SEQ ID NO: 1201 - RNA, 20 nt, artificial sequence
  siRNA Antisense Sequence
guuggagucugugcagcagu

SEQ ID NO: 1202 - RNA, 20 nt, artificial sequence
  siRNA Antisense Sequence
gagguuggagucugugcagc

SEQ ID NO: 1203 - RNA, 20 nt, artificial sequence
  siRNA Antisense Sequence
auugagguuggagucugugc

SEQ ID NO: 1204 - RNA, 20 nt, artificial sequence
  siRNA Antisense Sequence
cauugagguuggagucugug

SEQ ID NO: 1205 - RNA, 20 nt, artificial sequence
  siRNA Antisense Sequence
ccauugagguuggagucugu

SEQ ID NO: 1206 - RNA, 20 nt, artificial sequence
  siRNA Antisense Sequence
guacacuccauugagguugg

SEQ ID NO: 1207 - RNA, 20 nt, artificial sequence
  siRNA Antisense Sequence
uaguacacuccauugagguu

SEQ ID NO: 1208 - RNA, 20 nt, artificial sequence
  siRNA Antisense Sequence
gguaguacacuccauugagg

SEQ ID NO: 1209 - RNA, 20 nt, artificial sequence
  siRNA Antisense Sequence
cgguaguacacuccauugag

SEQ ID NO: 1210 - RNA, 20 nt, artificial sequence
  siRNA Antisense Sequence
gcgguaguacacuccauuga

SEQ ID NO: 1211 - RNA, 20 nt, artificial sequence
  siRNA Antisense Sequence
ggcgguaguacacuccauug

SEQ ID NO: 1212 - RNA, 20 nt, artificial sequence
  siRNA Antisense Sequence
aggcgguaguacacuccauu

SEQ ID NO: 1213 - RNA, 20 nt, artificial sequence
  siRNA Antisense Sequence
caggcgguaguacacuccau

SEQ ID NO: 1214 - RNA, 20 nt, artificial sequence
  siRNA Antisense Sequence
ccaggcgguaguacacucca

SEQ ID NO: 1215 - RNA, 20 nt, artificial sequence
  siRNA Antisense Sequence
cucacccaggcgguaguaca

SEQ ID NO: 1216 - RNA, 20 nt, artificial sequence
  siRNA Antisense Sequence
ugcucacccaggcgguagua

SEQ ID NO: 1217 - RNA, 20 nt, artificial sequence
  siRNA Antisense Sequence
gcuuauugugcucacccagg

SEQ ID NO: 1218 - RNA, 20 nt, artificial sequence
  siRNA Antisense Sequence
ugcuuauugugcucacccag

SEQ ID NO: 1219 - RNA, 20 nt, artificial sequence
  siRNA Antisense Sequence
gugcuuauugugcucaccca

SEQ ID NO: 1220 - RNA, 20 nt, artificial sequence
  siRNA Antisense Sequence
ccaggugcuuauugugcuca

SEQ ID NO: 1221 - RNA, 20 nt, artificial sequence
  siRNA Antisense Sequence
uccaggugcuuauugugcuc

SEQ ID NO: 1222 - RNA, 20 nt, artificial sequence
  siRNA Antisense Sequence
ccauccaggugcuuauugug

SEQ ID NO: 1223 - RNA, 20 nt, artificial sequence
  siRNA Antisense Sequence
gccauccaggugcuuauugu

SEQ ID NO: 1224 - RNA, 20 nt, artificial sequence
  siRNA Antisense Sequence
ugccauccaggugcuuauug

SEQ ID NO: 1225 - RNA, 20 nt, artificial sequence
  siRNA Antisense Sequence
augccauccaggugcuuauu

SEQ ID NO: 1226 - RNA, 20 nt, artificial sequence
  siRNA Antisense Sequence
gaugccauccaggugcuuau

SEQ ID NO: 1227 - RNA, 20 nt, artificial sequence
  siRNA Antisense Sequence
ugaugccauccaggugcuua

SEQ ID NO: 1228 - RNA, 20 nt, artificial sequence
  siRNA Antisense Sequence
accaggugaugccauccagg

SEQ ID NO: 1229 - RNA, 20 nt, artificial sequence
  siRNA Antisense Sequence
uaccaggugaugccauccag

SEQ ID NO: 1230 - RNA, 20 nt, artificial sequence
  siRNA Antisense Sequence
uagguagauccaugccagcc

SEQ ID NO: 1231 - RNA, 20 nt, artificial sequence
  siRNA Antisense Sequence
guagguagauccaugccagc

SEQ ID NO: 1232 - RNA, 20 nt, artificial sequence
  siRNA Antisense Sequence
gaguagguagauccaugcca

SEQ ID NO: 1233 - RNA, 20 nt, artificial sequence
  siRNA Antisense Sequence
ggaguagguagauccaugcc

SEQ ID NO: 1234 - RNA, 20 nt, artificial sequence
  siRNA Antisense Sequence
gggaguagguagauccaugc

SEQ ID NO: 1235 - RNA, 20 nt, artificial sequence
  siRNA Antisense Sequence
agggaguagguagauccaug

SEQ ID NO: 1236 - RNA, 20 nt, artificial sequence
  siRNA Antisense Sequence
gagggaguagguagauccau

SEQ ID NO: 1237 - RNA, 20 nt, artificial sequence
  siRNA Antisense Sequence
ugagggaguagguagaucca

SEQ ID NO: 1238 - RNA, 20 nt, artificial sequence
  siRNA Antisense Sequence
uugagggaguagguagaucc

SEQ ID NO: 1239 - RNA, 20 nt, artificial sequence
  siRNA Antisense Sequence
uuugagggaguagguagauc

SEQ ID NO: 1240 - RNA, 20 nt, artificial sequence
  siRNA Antisense Sequence
cguuugagggaguagguaga

SEQ ID NO: 1241 - RNA, 20 nt, artificial sequence
  siRNA Antisense Sequence
ccguuugagggaguagguag

SEQ ID NO: 1242 - RNA, 20 nt, artificial sequence
  siRNA Antisense Sequence
cccguuugagggaguaggua

SEQ ID NO: 1243 - RNA, 20 nt, artificial sequence
  siRNA Antisense Sequence
acccguuugagggaguaggu

SEQ ID NO: 1244 - RNA, 20 nt, artificial sequence
  siRNA Antisense Sequence
cacccguuugagggaguagg

SEQ ID NO: 1245 - RNA, 20 nt, artificial sequence
  siRNA Antisense Sequence
ccacccguuugagggaguag

SEQ ID NO: 1246 - RNA, 20 nt, artificial sequence
  siRNA Antisense Sequence
uccacccguuugagggagua

SEQ ID NO: 1247 - RNA, 20 nt, artificial sequence
  siRNA Antisense Sequence
aucuccacccguuugaggga

SEQ ID NO: 1248 - RNA, 20 nt, artificial sequence
  siRNA Antisense Sequence
caucuccacccguuugaggg

SEQ ID NO: 1249 - RNA, 20 nt, artificial sequence
  siRNA Antisense Sequence
ucaucuccacccguuugagg

SEQ ID NO: 1250 - RNA, 20 nt, artificial sequence
  siRNA Antisense Sequence
uucaucuccacccguuugag

SEQ ID NO: 1251 - RNA, 20 nt, artificial sequence
  siRNA Antisense Sequence
uuucaucuccacccguuuga

SEQ ID NO: 1252 - RNA, 20 nt, artificial sequence
  siRNA Antisense Sequence
uuuucaucuccacccguuug

SEQ ID NO: 1253 - RNA, 20 nt, artificial sequence
  siRNA Antisense Sequence
auuuucaucuccacccguuu

SEQ ID NO: 1254 - RNA, 20 nt, artificial sequence
  siRNA Antisense Sequence
ggcggauuuucaucuccacc

SEQ ID NO: 1255 - RNA, 20 nt, artificial sequence
  siRNA Antisense Sequence
ggcuugaagucuucugggcg

SEQ ID NO: 1256 - RNA, 20 nt, artificial sequence
  siRNA Antisense Sequence
aaggcuugaagucuucuggg

SEQ ID NO: 1257 - RNA, 20 nt, artificial sequence
  siRNA Antisense Sequence
ccuuuuaaggcuugaagucu

SEQ ID NO: 1258 - RNA, 20 nt, artificial sequence
  siRNA Antisense Sequence
cuccuuuuaaggcuugaagu

SEQ ID NO: 1259 - RNA, 20 nt, artificial sequence
  siRNA Antisense Sequence
ccuccuuuuaaggcuugaag

SEQ ID NO: 1260 - RNA, 20 nt, artificial sequence
  siRNA Antisense Sequence
acggcagccuccuuuuaagg

SEQ ID NO: 1261 - RNA, 20 nt, artificial sequence
  siRNA Antisense Sequence
cacggcagccuccuuuuaag

SEQ ID NO: 1262 - RNA, 20 nt, artificial sequence
  siRNA Antisense Sequence
cuccacggcagccuccuuuu

SEQ ID NO: 1263 - RNA, 20 nt, artificial sequence
  siRNA Antisense Sequence
uuucuguauccgugcuccac

SEQ ID NO: 1264 - RNA, 20 nt, artificial sequence
  siRNA Antisense Sequence
aguuucuguauccgugcucc

SEQ ID NO: 1265 - RNA, 20 nt, artificial sequence
  siRNA Antisense Sequence
caguuucuguauccgugcuc

SEQ ID NO: 1266 - RNA, 20 nt, artificial sequence
  siRNA Antisense Sequence
cucaguuucuguauccgugc

SEQ ID NO: 1267 - RNA, 20 nt, artificial sequence
  siRNA Antisense Sequence
ugucucaguuucuguauccg

SEQ ID NO: 1268 - RNA, 20 nt, artificial sequence
  siRNA Antisense Sequence
ugcccucauccagucuccac

SEQ ID NO: 1269 - RNA, 20 nt, artificial sequence
  siRNA Antisense Sequence
aucugcccucauccagucuc

SEQ ID NO: 1270 - RNA, 20 nt, artificial sequence
  siRNA Antisense Sequence
caucugcccucauccagucu

SEQ ID NO: 1271 - RNA, 20 nt, artificial sequence
  siRNA Antisense Sequence
ucaucugcccucauccaguc

SEQ ID NO: 1272 - RNA, 20 nt, artificial sequence
  siRNA Antisense Sequence
ccucaucugcccucauccag

SEQ ID NO: 1273 - RNA, 20 nt, artificial sequence
  siRNA Antisense Sequence
cuaacacucucuuccugucc

SEQ ID NO: 1274 - RNA, 20 nt, artificial sequence
  siRNA Antisense Sequence
ucuaacacucucuuccuguc

SEQ ID NO: 1275 - RNA, 20 nt, artificial sequence
  siRNA Antisense Sequence
uucuaacacucucuuccugu

SEQ ID NO: 1276 - RNA, 20 nt, artificial sequence
  siRNA Antisense Sequence
uauaggcuguuucucagucc

SEQ ID NO: 1277 - RNA, 20 nt, artificial sequence
  siRNA Antisense Sequence
ccuuggagacuuauucuuuc

SEQ ID NO: 1278 - RNA, 20 nt, artificial sequence
  siRNA Antisense Sequence
gcuccuuggagacuuauucu

SEQ ID NO: 1279 - RNA, 20 nt, artificial sequence
  siRNA Antisense Sequence
ugcuccuuggagacuuauuc

SEQ ID NO: 1280 - RNA, 20 nt, artificial sequence
  siRNA Antisense Sequence
uuuugugcuccuuggagacu

SEQ ID NO: 1281 - RNA, 20 nt, artificial sequence
  siRNA Antisense Sequence
uacuguaacauccuugguac

SEQ ID NO: 1282 - RNA, 20 nt, artificial sequence
  siRNA Antisense Sequence
guuuacuguaacauccuugg

SEQ ID NO: 1283 - RNA, 20 nt, artificial sequence
  siRNA Antisense Sequence
aggauguggcaggacccagu

SEQ ID NO: 1284 - RNA, 20 nt, artificial sequence
  siRNA Antisense Sequence
aaggauguggcaggacccag

SEQ ID NO: 1285 - RNA, 20 nt, artificial sequence
  siRNA Antisense Sequence
gaaggauguggcaggaccca

SEQ ID NO: 1286 - RNA, 20 nt, artificial sequence
  siRNA Antisense Sequence
ugagaaggauguggcaggac

SEQ ID NO: 1287 - RNA, 20 nt, artificial sequence
  siRNA Antisense Sequence
cagucuaccaccuugagaag

SEQ ID NO: 1288 - RNA, 20 nt, artificial sequence
  siRNA Antisense Sequence
cacucagucuaccaccuuga

SEQ ID NO: 1289 - RNA, 20 nt, artificial sequence
  siRNA Antisense Sequence
ggaucuugggcagagagacc

SEQ ID NO: 1290 - RNA, 20 nt, artificial sequence
  siRNA Antisense Sequence
gggaucuugggcagagagac

SEQ ID NO: 1291 - RNA, 20 nt, artificial sequence
  siRNA Antisense Sequence
agggaucuugggcagagaga

SEQ ID NO: 1292 - RNA, 20 nt, artificial sequence
  siRNA Antisense Sequence
cagggaucuugggcagagag

SEQ ID NO: 1293 - RNA, 20 nt, artificial sequence
  siRNA Antisense Sequence
ugucagggaucuugggcaga

SEQ ID NO: 1294 - RNA, 20 nt, artificial sequence
  siRNA Antisense Sequence
augucagggaucuugggcag

SEQ ID NO: 1295 - RNA, 20 nt, artificial sequence
  siRNA Antisense Sequence
uaugucagggaucuugggca

SEQ ID NO: 1296 - RNA, 20 nt, artificial sequence
  siRNA Antisense Sequence
cuaugucagggaucuugggc

SEQ ID NO: 1297 - RNA, 20 nt, artificial sequence
  siRNA Antisense Sequence
gcuaugucagggaucuuggg

SEQ ID NO: 1298 - RNA, 20 nt, artificial sequence
  siRNA Antisense Sequence
ugcuaugucagggaucuugg

SEQ ID NO: 1299 - RNA, 20 nt, artificial sequence
  siRNA Antisense Sequence
cugcuaugucagggaucuug

SEQ ID NO: 1300 - RNA, 20 nt, artificial sequence
  siRNA Antisense Sequence
agcuacugcuaugucaggga

SEQ ID NO: 1301 - RNA, 20 nt, artificial sequence
  siRNA Antisense Sequence
aagcuacugcuaugucaggg

SEQ ID NO: 1302 - RNA, 20 nt, artificial sequence
  siRNA Antisense Sequence
aagacaagcuacugcuaugu

SEQ ID NO: 1303 - RNA, 20 nt, artificial sequence
  siRNA Antisense Sequence
cauguggaaaagacaagcua

SEQ ID NO: 1304 - RNA, 20 nt, artificial sequence
  siRNA Antisense Sequence
aucauguggaaaagacaagc

SEQ ID NO: 1305 - RNA, 20 nt, artificial sequence
  siRNA Antisense Sequence
gcccucacauagccuaagcc

SEQ ID NO: 1306 - RNA, 20 nt, artificial sequence
  siRNA Antisense Sequence
uugcccucacauagccuaag

SEQ ID NO: 1307 - RNA, 20 nt, artificial sequence
  siRNA Antisense Sequence
uuugcccucacauagccuaa

SEQ ID NO: 1308 - RNA, 20 nt, artificial sequence
  siRNA Antisense Sequence
uuuugcccucacauagccua

SEQ ID NO: 1309 - RNA, 20 nt, artificial sequence
  siRNA Antisense Sequence
guuuugcccucacauagccu

SEQ ID NO: 1310 - RNA, 20 nt, artificial sequence
  siRNA Antisense Sequence
uguuuugcccucacauagcc

SEQ ID NO: 1311 - RNA, 20 nt, artificial sequence
  siRNA Antisense Sequence
guguuuugcccucacauagc

SEQ ID NO: 1312 - RNA, 20 nt, artificial sequence
  siRNA Antisense Sequence
gauuuguguuuugcccucac

SEQ ID NO: 1313 - RNA, 20 nt, artificial sequence
  siRNA Antisense Sequence
ggauuuguguuuugcccuca

SEQ ID NO: 1314 - RNA, 20 nt, artificial sequence
  siRNA Antisense Sequence
aagggauuuguguuuugccc

SEQ ID NO: 1315 - RNA, 20 nt, artificial sequence
  siRNA Antisense Sequence
acuccuuucucuaacacuca

SEQ ID NO: 1316 - RNA, 20 nt, artificial sequence
  siRNA Antisense Sequence
caccugccuccuucacuccu

SEQ ID NO: 1317 - RNA, 20 nt, artificial sequence
  siRNA Antisense Sequence
uaccauuucccaccugccuc

SEQ ID NO: 1318 - RNA, 20 nt, artificial sequence
  siRNA Antisense Sequence
auaccauuucccaccugccu

SEQ ID NO: 1319 - RNA, 20 nt, artificial sequence
  siRNA Antisense Sequence
uccagccugggucaguucca

SEQ ID NO: 1320 - RNA, 20 nt, artificial sequence
  siRNA Antisense Sequence
ugcagugcccuggaguuucc

SEQ ID NO: 1321 - RNA, 20 nt, artificial sequence
  siRNA Antisense Sequence
gaugcagugcccuggaguuu

SEQ ID NO: 1322 - RNA, 20 nt, artificial sequence
  siRNA Antisense Sequence
cagaugcagugcccuggagu

SEQ ID NO: 1323 - RNA, 20 nt, artificial sequence
  siRNA Antisense Sequence
ugaucgccagaugcagugcc

SEQ ID NO: 1324 - RNA, 20 nt, artificial sequence
  siRNA Antisense Sequence
cugaucgccagaugcagugc

SEQ ID NO: 1325 - RNA, 20 nt, artificial sequence
  siRNA Antisense Sequence
acaugaccaaggcgagcagg

SEQ ID NO: 1326 - RNA, 20 nt, artificial sequence
  siRNA Antisense Sequence
uacaugaccaaggcgagcag

SEQ ID NO: 1327 - RNA, 20 nt, artificial sequence
  siRNA Antisense Sequence
gcuggugcuucauuccuuuc

SEQ ID NO: 1328 - RNA, 20 nt, artificial sequence
  siRNA Antisense Sequence
cugcuggugcuucauuccuu

SEQ ID NO: 1329 - RNA, 20 nt, artificial sequence
  siRNA Antisense Sequence
ccugcuggugcuucauuccu

SEQ ID NO: 1330 - RNA, 20 nt, artificial sequence
  siRNA Antisense Sequence
acucuguccaccuccugcug

SEQ ID NO: 1331 - RNA, 20 nt, artificial sequence
  siRNA Antisense Sequence
agagacucuguccaccuccu

SEQ ID NO: 1332 - RNA, 20 nt, artificial sequence
  siRNA Antisense Sequence
augagagacucuguccaccu

SEQ ID NO: 1333 - RNA, 20 nt, artificial sequence
  siRNA Antisense Sequence
cauccaugagagacucuguc

SEQ ID NO: 1334 - RNA, 20 nt, artificial sequence
  siRNA Antisense Sequence
gcauccaugagagacucugu

SEQ ID NO: 1335 - RNA, 20 nt, artificial sequence
  siRNA Antisense Sequence
ggcauccaugagagacucug

SEQ ID NO: 1336 - RNA, 20 nt, artificial sequence
  siRNA Antisense Sequence
ccuugagcuuguuucuuaca

SEQ ID NO: 1337 - RNA, 20 nt, artificial sequence
  siRNA Antisense Sequence
uucaaccauuuccuacagac

SEQ ID NO: 1338 - RNA, 20 nt, artificial sequence
  siRNA Antisense Sequence
ccaucuaccuucaguuuuca

SEQ ID NO: 1339 - RNA, 20 nt, artificial sequence
  siRNA Antisense Sequence
acaccaucuaccuucaguuu

SEQ ID NO: 1340 - RNA, 20 nt, artificial sequence
  siRNA Antisense Sequence
aacaccaucuaccuucaguu

SEQ ID NO: 1341 - RNA, 20 nt, artificial sequence
  siRNA Antisense Sequence
uaacaccaucuaccuucagu

SEQ ID NO: 1342 - RNA, 20 nt, artificial sequence
  siRNA Antisense Sequence
agaaggagacaaggccacuu

SEQ ID NO: 1343 - RNA, 20 nt, artificial sequence
  siRNA Antisense Sequence
uagaaggagacaaggccacu

SEQ ID NO: 1344 - RNA, 20 nt, artificial sequence
  siRNA Antisense Sequence
ucccgguagaaggagacaag

SEQ ID NO: 1345 - RNA, 20 nt, artificial sequence
  siRNA Antisense Sequence
gucccgguagaaggagacaa

SEQ ID NO: 1346 - RNA, 20 nt, artificial sequence
  siRNA Antisense Sequence
agucccgguagaaggagaca

SEQ ID NO: 1347 - RNA, 20 nt, artificial sequence
  siRNA Antisense Sequence
cagucccgguagaaggagac

SEQ ID NO: 1348 - RNA, 20 nt, artificial sequence
  siRNA Antisense Sequence
ccagucccgguagaaggaga

SEQ ID NO: 1349 - RNA, 20 nt, artificial sequence
  siRNA Antisense Sequence
uccagucccgguagaaggag

SEQ ID NO: 1350 - RNA, 20 nt, artificial sequence
  siRNA Antisense Sequence
uuccagucccgguagaagga

SEQ ID NO: 1351 - RNA, 20 nt, artificial sequence
  siRNA Antisense Sequence
ugcuuccagucccgguagaa

SEQ ID NO: 1352 - RNA, 20 nt, artificial sequence
  siRNA Antisense Sequence
cugcuuccagucccgguaga

SEQ ID NO: 1353 - RNA, 20 nt, artificial sequence
  siRNA Antisense Sequence
ccugcuuguacugcuuccag

SEQ ID NO: 1354 - RNA, 20 nt, artificial sequence
  siRNA Antisense Sequence
cccugcuuguacugcuucca

SEQ ID NO: 1355 - RNA, 20 nt, artificial sequence
  siRNA Antisense Sequence
gaugcugccaaagcccugcu

SEQ ID NO: 1356 - RNA, 20 nt, artificial sequence
  siRNA Antisense Sequence
acggaugcugccaaagcccu

SEQ ID NO: 1357 - RNA, 20 nt, artificial sequence
  siRNA Antisense Sequence
cgguggauguguucguuccc

SEQ ID NO: 1358 - RNA, 20 nt, artificial sequence
  siRNA Antisense Sequence
ccgguggauguguucguucc

SEQ ID NO: 1359 - RNA, 20 nt, artificial sequence
  siRNA Antisense Sequence
gccgguggauguguucguuc

SEQ ID NO: 1360 - RNA, 20 nt, artificial sequence
  siRNA Antisense Sequence
agccgguggauguguucguu

SEQ ID NO: 1361 - RNA, 20 nt, artificial sequence
  siRNA Antisense Sequence
gagccgguggauguguucgu

SEQ ID NO: 1362 - RNA, 20 nt, artificial sequence
  siRNA Antisense Sequence
agagccgguggauguguucg

SEQ ID NO: 1363 - RNA, 20 nt, artificial sequence
  siRNA Antisense Sequence
gagagccgguggauguguuc

SEQ ID NO: 1364 - RNA, 20 nt, artificial sequence
  siRNA Antisense Sequence
ggagagccgguggauguguu

SEQ ID NO: 1365 - RNA, 20 nt, artificial sequence
  siRNA Antisense Sequence
uggagagccgguggaugugu

SEQ ID NO: 1366 - RNA, 20 nt, artificial sequence
  siRNA Antisense Sequence
ucuggagagccgguggaugu

SEQ ID NO: 1367 - RNA, 20 nt, artificial sequence
  siRNA Antisense Sequence
ugucuggagagccgguggau

SEQ ID NO: 1368 - RNA, 20 nt, artificial sequence
  siRNA Antisense Sequence
ugugcuuaccuccaucucua

SEQ ID NO: 1369 - RNA, 20 nt, artificial sequence
  siRNA Antisense Sequence
uugugcuuaccuccaucucu

SEQ ID NO: 1370 - RNA, 20 nt, artificial sequence
  siRNA Antisense Sequence
ccggaguuguacgcggucau

SEQ ID NO: 1371 - RNA, 20 nt, artificial sequence
  siRNA Antisense Sequence
ucagaauaggaauggcaccc

SEQ ID NO: 1372 - RNA, 20 nt, artificial sequence
  siRNA Antisense Sequence
aucagaauaggaauggcacc

SEQ ID NO: 1373 - RNA, 20 nt, artificial sequence
  siRNA Antisense Sequence
aaucagaauaggaauggcac

SEQ ID NO: 1374 - RNA, 20 nt, artificial sequence
  siRNA Antisense Sequence
gaaucagaauaggaauggca

SEQ ID NO: 1375 - RNA, 20 nt, artificial sequence
  siRNA Antisense Sequence
gcaggaaaaccaucacaaug

SEQ ID NO: 1376 - RNA, 20 nt, artificial sequence
  siRNA Antisense Sequence
ugcaggaaaaccaucacaau

SEQ ID NO: 1377 - RNA, 20 nt, artificial sequence
  siRNA Antisense Sequence
uugcaggaaaaccaucacaa

SEQ ID NO: 1378 - RNA, 20 nt, artificial sequence
  siRNA Antisense Sequence
uuacaacuugcaggaaaacc

SEQ ID NO: 1379 - RNA, 20 nt, artificial sequence
  siRNA Antisense Sequence
cuccauuacaacuugcagga

SEQ ID NO: 1380 - RNA, 20 nt, artificial sequence
  siRNA Antisense Sequence
acuccauuacaacuugcagg

SEQ ID NO: 1381 - RNA, 20 nt, artificial sequence
  siRNA Antisense Sequence
aacuccauuacaacuugcag

SEQ ID NO: 1382 - RNA, 20 nt, artificial sequence
  siRNA Antisense Sequence
caacuccauuacaacuugca

SEQ ID NO: 1383 - RNA, 20 nt, artificial sequence
  siRNA Antisense Sequence
ccucaacuccauuacaacuu

SEQ ID NO: 1384 - RNA, 20 nt, artificial sequence
  siRNA Antisense Sequence
uccucaacuccauuacaacu

SEQ ID NO: 1385 - RNA, 20 nt, artificial sequence
  siRNA Antisense Sequence
uuccucaacuccauuacaac

SEQ ID NO: 1386 - RNA, 20 nt, artificial sequence
  siRNA Antisense Sequence
ucuacucuggccugggucug

SEQ ID NO: 1387 - RNA, 20 nt, artificial sequence
  siRNA Antisense Sequence
ugaauuugcucuacucuggc

SEQ ID NO: 1388 - RNA, 20 nt, artificial sequence
  siRNA Antisense Sequence
uugaauuugcucuacucugg

SEQ ID NO: 1389 - RNA, 20 nt, artificial sequence
  siRNA Antisense Sequence
guugaauuugcucuacucug

SEQ ID NO: 1390 - RNA, 20 nt, artificial sequence
  siRNA Antisense Sequence
ucggccagagcagagacuag

SEQ ID NO: 1391 - RNA, 20 nt, artificial sequence
  siRNA Antisense Sequence
cucggccagagcagagacua

SEQ ID NO: 1392 - RNA, 20 nt, artificial sequence
  siRNA Antisense Sequence
aaggaccucaugcucggcca

SEQ ID NO: 1393 - RNA, 20 nt, artificial sequence
  siRNA Antisense Sequence
aaaggaccucaugcucggcc

SEQ ID NO: 1394 - RNA, 20 nt, artificial sequence
  siRNA Antisense Sequence
uaaaggaccucaugcucggc

SEQ ID NO: 1395 - RNA, 20 nt, artificial sequence
  siRNA Antisense Sequence
cuaaaggaccucaugcucgg

SEQ ID NO: 1396 - RNA, 20 nt, artificial sequence
  siRNA Antisense Sequence
ccuaaaggaccucaugcucg

SEQ ID NO: 1397 - RNA, 20 nt, artificial sequence
  siRNA Antisense Sequence
accuaaaggaccucaugcuc

SEQ ID NO: 1398 - RNA, 20 nt, artificial sequence
  siRNA Antisense Sequence
caccuaaaggaccucaugcu

SEQ ID NO: 1399 - RNA, 20 nt, artificial sequence
  siRNA Antisense Sequence
gcaccuaaaggaccucaugc

SEQ ID NO: 1400 - RNA, 20 nt, artificial sequence
  siRNA Antisense Sequence
ugcaccuaaaggaccucaug

SEQ ID NO: 1401 - RNA, 20 nt, artificial sequence
  siRNA Antisense Sequence
uugcaccuaaaggaccucau

SEQ ID NO: 1402 - RNA, 20 nt, artificial sequence
  siRNA Antisense Sequence
auuugcaccuaaaggaccuc

SEQ ID NO: 1403 - RNA, 20 nt, artificial sequence
  siRNA Antisense Sequence
gauuugcaccuaaaggaccu

SEQ ID NO: 1404 - RNA, 20 nt, artificial sequence
  siRNA Antisense Sequence
agauuugcaccuaaaggacc

SEQ ID NO: 1405 - RNA, 20 nt, artificial sequence
  siRNA Antisense Sequence
aagauuugcaccuaaaggac

SEQ ID NO: 1406 - RNA, 20 nt, artificial sequence
  siRNA Antisense Sequence
guaagauuugcaccuaaagg

SEQ ID NO: 1407 - RNA, 20 nt, artificial sequence
  siRNA Antisense Sequence
gugagugcuuucagaccuuc

SEQ ID NO: 1408 - RNA, 20 nt, artificial sequence
  siRNA Antisense Sequence
agugagugcuuucagaccuu

SEQ ID NO: 1409 - RNA, 20 nt, artificial sequence
  siRNA Antisense Sequence
uagugagugcuuucagaccu

SEQ ID NO: 1410 - RNA, 20 nt, artificial sequence
  siRNA Antisense Sequence
uauagugagugcuuucagac

SEQ ID NO: 1411 - RNA, 20 nt, artificial sequence
  siRNA Antisense Sequence
gauauagugagugcuuucag

SEQ ID NO: 1412 - RNA, 20 nt, artificial sequence
  siRNA Antisense Sequence
aggauauagugagugcuuuc

SEQ ID NO: 1413 - RNA, 20 nt, artificial sequence
  siRNA Antisense Sequence
gaggauauagugagugcuuu

SEQ ID NO: 1414 - RNA, 20 nt, artificial sequence
  siRNA Antisense Sequence
agagcugcuguaagagaaac

SEQ ID NO: 1415 - RNA, 20 nt, artificial sequence
  siRNA Antisense Sequence
cagagcugcuguaagagaaa

SEQ ID NO: 1416 - RNA, 20 nt, artificial sequence
  siRNA Antisense Sequence
gaaucccacacagagcugcu

SEQ ID NO: 1417 - RNA, 20 nt, artificial sequence
  siRNA Antisense Sequence
cuauauuccucacuuuccug

SEQ ID NO: 1418 - RNA, 20 nt, artificial sequence
  siRNA Antisense Sequence
ggccuugauuagucucucuu

SEQ ID NO: 1419 - RNA, 20 nt, artificial sequence
  siRNA Antisense Sequence
uggccuugauuagucucucu

SEQ ID NO: 1420 - RNA, 20 nt, artificial sequence
  siRNA Antisense Sequence
auggccuugauuagucucuc

SEQ ID NO: 1421 - RNA, 20 nt, artificial sequence
  siRNA Antisense Sequence
uauggccuugauuagucucu

SEQ ID NO: 1422 - RNA, 20 nt, artificial sequence
  siRNA Antisense Sequence
auauggccuugauuagucuc

SEQ ID NO: 1423 - RNA, 20 nt, artificial sequence
  siRNA Antisense Sequence
gaacuucuuuccugauucac

SEQ ID NO: 1424 - RNA, 20 nt, artificial sequence
  siRNA Antisense Sequence
ucgaacuucuuuccugauuc

SEQ ID NO: 1425 - RNA, 20 nt, artificial sequence
  siRNA Antisense Sequence
cucgaacuucuuuccugauu

SEQ ID NO: 1426 - RNA, 20 nt, artificial sequence
  siRNA Antisense Sequence
gcucgaacuucuuuccugau

SEQ ID NO: 1427 - RNA, 20 nt, artificial sequence
  siRNA Antisense Sequence
ggcucgaacuucuuuccuga

SEQ ID NO: 1428 - RNA, 20 nt, artificial sequence
  siRNA Antisense Sequence
aggcucgaacuucuuuccug

SEQ ID NO: 1429 - RNA, 20 nt, artificial sequence
  siRNA Antisense Sequence
aaggcucgaacuucuuuccu

SEQ ID NO: 1430 - RNA, 20 nt, artificial sequence
  siRNA Antisense Sequence
caaggcucgaacuucuuucc

SEQ ID NO: 1431 - RNA, 20 nt, artificial sequence
  siRNA Antisense Sequence
acaaggcucgaacuucuuuc

SEQ ID NO: 1432 - RNA, 20 nt, artificial sequence
  siRNA Antisense Sequence
aacaaggcucgaacuucuuu

SEQ ID NO: 1433 - RNA, 20 nt, artificial sequence
  siRNA Antisense Sequence
aaacaaggcucgaacuucuu

SEQ ID NO: 1434 - RNA, 20 nt, artificial sequence
  siRNA Antisense Sequence
aaaacaaggcucgaacuucu

SEQ ID NO: 1435 - RNA, 20 nt, artificial sequence
  siRNA Antisense Sequence
gaaaacaaggcucgaacuuc

SEQ ID NO: 1436 - RNA, 20 nt, artificial sequence
  siRNA Antisense Sequence
agaaaacaaggcucgaacuu

SEQ ID NO: 1437 - RNA, 20 nt, artificial sequence
  siRNA Antisense Sequence
aaucagaaaacaaggcucga

SEQ ID NO: 1438 - RNA, 20 nt, artificial sequence
  siRNA Antisense Sequence
ccugggaaucagaaaacaag

SEQ ID NO: 1439 - RNA, 20 nt, artificial sequence
  siRNA Antisense Sequence
accuccaguuuacuguguua

SEQ ID NO: 1440 - RNA, 20 nt, artificial sequence
  siRNA Antisense Sequence
uuaccuccaguuuacugugu

SEQ ID NO: 1441 - RNA, 20 nt, artificial sequence
  siRNA Antisense Sequence
guuuaccuccaguuuacugu

SEQ ID NO: 1442 - RNA, 20 nt, artificial sequence
  siRNA Antisense Sequence
uguuuaccuccaguuuacug

SEQ ID NO: 1443 - RNA, 20 nt, artificial sequence
  siRNA Antisense Sequence
cuuguuuaccuccaguuuac

SEQ ID NO: 1444 - RNA, 20 nt, artificial sequence
  siRNA Antisense Sequence
agucccauagccaaacaucu

SEQ ID NO: 1445 - RNA, 20 nt, artificial sequence
  siRNA Antisense Sequence
cagucccauagccaaacauc

SEQ ID NO: 1446 - RNA, 20 nt, artificial sequence
  siRNA Antisense Sequence
acagucccauagccaaacau

SEQ ID NO: 1447 - RNA, 20 nt, artificial sequence
  siRNA Antisense Sequence
gacagucccauagccaaaca

SEQ ID NO: 1448 - RNA, 20 nt, artificial sequence
  siRNA Antisense Sequence
ugacagucccauagccaaac

SEQ ID NO: 1449 - RNA, 20 nt, artificial sequence
  siRNA Antisense Sequence
cugacagucccauagccaaa

SEQ ID NO: 1450 - RNA, 20 nt, artificial sequence
  siRNA Antisense Sequence
ccugacagucccauagccaa

SEQ ID NO: 1451 - RNA, 20 nt, artificial sequence
  siRNA Antisense Sequence
ucuccugacagucccauagc

SEQ ID NO: 1452 - RNA, 20 nt, artificial sequence
  siRNA Antisense Sequence
cucuccugacagucccauag

SEQ ID NO: 1453 - RNA, 20 nt, artificial sequence
  siRNA Antisense Sequence
ucucuccugacagucccaua

SEQ ID NO: 1454 - RNA, 20 nt, artificial sequence
  siRNA Antisense Sequence
ccuucucuccugacaguccc

SEQ ID NO: 1455 - RNA, 20 nt, artificial sequence
  siRNA Antisense Sequence
ggcuccauuucaugcugucu

SEQ ID NO: 1456 - RNA, 20 nt, artificial sequence
  siRNA Antisense Sequence
aggcuccauuucaugcuguc

SEQ ID NO: 1457 - RNA, 20 nt, artificial sequence
  siRNA Antisense Sequence
gcaggcuccauuucaugcug

SEQ ID NO: 1458 - RNA, 20 nt, artificial sequence
  siRNA Antisense Sequence
gcagcaggcuccauuucaug

SEQ ID NO: 1459 - RNA, 20 nt, artificial sequence
  siRNA Antisense Sequence
aagugcagcaggcuccauuu

SEQ ID NO: 1460 - RNA, 20 nt, artificial sequence
  siRNA Antisense Sequence
aaagugcagcaggcuccauu

SEQ ID NO: 1461 - RNA, 20 nt, artificial sequence
  siRNA Antisense Sequence
gaaagugcagcaggcuccau

SEQ ID NO: 1462 - RNA, 20 nt, artificial sequence
  siRNA Antisense Sequence
agaaagugcagcaggcucca

SEQ ID NO: 1463 - RNA, 20 nt, artificial sequence
  siRNA Antisense Sequence
aagaaagugcagcaggcucc

SEQ ID NO: 1464 - RNA, 20 nt, artificial sequence
  siRNA Antisense Sequence
uaaagaaagugcagcaggcu

SEQ ID NO: 1465 - RNA, 20 nt, artificial sequence
  siRNA Antisense Sequence
uuaaagaaagugcagcaggc

SEQ ID NO: 1466 - RNA, 20 nt, artificial sequence
  siRNA Antisense Sequence
cuuaaagaaagugcagcagg

SEQ ID NO: 1467 - RNA, 20 nt, artificial sequence
  siRNA Antisense Sequence
gccuuaaagaaagugcagca

SEQ ID NO: 1468 - RNA, 20 nt, artificial sequence
  siRNA Antisense Sequence
agccuuaaagaaagugcagc

SEQ ID NO: 1469 - RNA, 20 nt, artificial sequence
  siRNA Antisense Sequence
agcagagccuuaaagaaagu

SEQ ID NO: 1470 - RNA, 20 nt, artificial sequence
  siRNA Antisense Sequence
gagcagagccuuaaagaaag

SEQ ID NO: 1471 - RNA, 20 nt, artificial sequence
  siRNA Antisense Sequence
aggagcagagccuuaaagaa

SEQ ID NO: 1472 - RNA, 20 nt, artificial sequence
  siRNA Antisense Sequence
gaggagcagagccuuaaaga

SEQ ID NO: 1473 - RNA, 20 nt, artificial sequence
  siRNA Antisense Sequence
aggaggagcagagccuuaaa

SEQ ID NO: 1474 - RNA, 20 nt, artificial sequence
  siRNA Antisense Sequence
ucaggaggagcagagccuua

SEQ ID NO: 1475 - RNA, 20 nt, artificial sequence
  siRNA Antisense Sequence
uugcccucccaguccuguca

SEQ ID NO: 1476 - RNA, 20 nt, artificial sequence
  siRNA Antisense Sequence
acucagcguagcgcagguug

SEQ ID NO: 1477 - RNA, 20 nt, artificial sequence
  siRNA Antisense Sequence
uacucagcguagcgcagguu

SEQ ID NO: 1478 - RNA, 20 nt, artificial sequence
  siRNA Antisense Sequence
uauacucagcguagcgcagg

SEQ ID NO: 1479 - RNA, 20 nt, artificial sequence
  siRNA Antisense Sequence
cuauacucagcguagcgcag

SEQ ID NO: 1480 - RNA, 20 nt, artificial sequence
  siRNA Antisense Sequence
acaaaguggcuauacucagc

SEQ ID NO: 1481 - RNA, 20 nt, artificial sequence
  siRNA Antisense Sequence
aacaaaguggcuauacucag

SEQ ID NO: 1482 - RNA, 20 nt, artificial sequence
  siRNA Antisense Sequence
cauugcccaaaacaaagugg

SEQ ID NO: 1483 - RNA, 20 nt, artificial sequence
  siRNA Antisense Sequence
guugaguucauugcccaaaa

SEQ ID NO: 1484 - RNA, 20 nt, artificial sequence
  siRNA Antisense Sequence
uguugaguucauugcccaaa

SEQ ID NO: 1485 - RNA, 20 nt, artificial sequence
  siRNA Antisense Sequence
cuguugaguucauugcccaa

SEQ ID NO: 1486 - RNA, 20 nt, artificial sequence
  siRNA Antisense Sequence
gcuguugaguucauugccca

SEQ ID NO: 1487 - RNA, 20 nt, artificial sequence
  siRNA Antisense Sequence
cgauagcuguugaguucauu

SEQ ID NO: 1488 - RNA, 20 nt, artificial sequence
  siRNA Antisense Sequence
ggcgauagcuguugaguuca

SEQ ID NO: 1489 - RNA, 20 nt, artificial sequence
  siRNA Antisense Sequence
aggcgauagcuguugaguuc

SEQ ID NO: 1490 - RNA, 20 nt, artificial sequence
  siRNA Antisense Sequence
gaggcgauagcuguugaguu

SEQ ID NO: 1491 - RNA, 20 nt, artificial sequence
  siRNA Antisense Sequence
agaggcgauagcuguugagu

SEQ ID NO: 1492 - RNA, 20 nt, artificial sequence
  siRNA Antisense Sequence
aagaggcgauagcuguugag

SEQ ID NO: 1493 - RNA, 20 nt, artificial sequence
  siRNA Antisense Sequence
gaagaggcgauagcuguuga

SEQ ID NO: 1494 - RNA, 20 nt, artificial sequence
  siRNA Antisense Sequence
ggaagaggcgauagcuguug

SEQ ID NO: 1495 - RNA, 20 nt, artificial sequence
  siRNA Antisense Sequence
aggaagaggcgauagcuguu

SEQ ID NO: 1496 - RNA, 20 nt, artificial sequence
  siRNA Antisense Sequence
caggaagaggcgauagcugu

SEQ ID NO: 1497 - RNA, 20 nt, artificial sequence
  siRNA Antisense Sequence
ccaggaagaggcgauagcug

SEQ ID NO: 1498 - RNA, 20 nt, artificial sequence
  siRNA Antisense Sequence
cccaggaagaggcgauagcu

SEQ ID NO: 1499 - RNA, 20 nt, artificial sequence
  siRNA Antisense Sequence
acauugccaguguaguuccc

SEQ ID NO: 1500 - RNA, 20 nt, artificial sequence
  siRNA Antisense Sequence
cacauugccaguguaguucc

SEQ ID NO: 1501 - RNA, 20 nt, artificial sequence
  siRNA Antisense Sequence
ccacauugccaguguaguuc

SEQ ID NO: 1502 - RNA, 20 nt, artificial sequence
  siRNA Antisense Sequence
cccacauugccaguguaguu

SEQ ID NO: 1503 - RNA, 20 nt, artificial sequence
  siRNA Antisense Sequence
auacuggagggcgucguucc

SEQ ID NO: 1504 - RNA, 20 nt, artificial sequence
  siRNA Antisense Sequence
gauacuggagggcgucguuc

SEQ ID NO: 1505 - RNA, 20 nt, artificial sequence
  siRNA Antisense Sequence
ugauacuggagggcgucguu

SEQ ID NO: 1506 - RNA, 20 nt, artificial sequence
  siRNA Antisense Sequence
augauacuggagggcgucgu

SEQ ID NO: 1507 - RNA, 20 nt, artificial sequence
  siRNA Antisense Sequence
uaugauacuggagggcgucg

SEQ ID NO: 1508 - RNA, 20 nt, artificial sequence
  siRNA Antisense Sequence
uuguuaugauacuggagggc

SEQ ID NO: 1509 - RNA, 20 nt, artificial sequence
  siRNA Antisense Sequence
guuguuaugauacuggaggg

SEQ ID NO: 1510 - RNA, 20 nt, artificial sequence
  siRNA Antisense Sequence
uguuguuaugauacuggagg

SEQ ID NO: 1511 - RNA, 20 nt, artificial sequence
  siRNA Antisense Sequence
cuguguuguuaugauacugg

SEQ ID NO: 1512 - RNA, 20 nt, artificial sequence
  siRNA Antisense Sequence
gcuguguuguuaugauacug

SEQ ID NO: 1513 - RNA, 20 nt, artificial sequence
  siRNA Antisense Sequence
ggcuguguuguuaugauacu

SEQ ID NO: 1514 - RNA, 20 nt, artificial sequence
  siRNA Antisense Sequence
aggcuguguuguuaugauac

SEQ ID NO: 1515 - RNA, 20 nt, artificial sequence
  siRNA Antisense Sequence
gaaggcuguguuguuaugau

SEQ ID NO: 1516 - RNA, 20 nt, artificial sequence
  siRNA Antisense Sequence
ugaaggcuguguuguuauga

SEQ ID NO: 1517 - RNA, 20 nt, artificial sequence
  siRNA Antisense Sequence
cugaaggcuguguuguuaug

SEQ ID NO: 1518 - RNA, 20 nt, artificial sequence
  siRNA Antisense Sequence
gcugaaggcuguguuguuau

SEQ ID NO: 1519 - RNA, 20 nt, artificial sequence
  siRNA Antisense Sequence
ugcugaaggcuguguuguua

SEQ ID NO: 1520 - RNA, 20 nt, artificial sequence
  siRNA Antisense Sequence
uguccuuguccuuggugcug

SEQ ID NO: 1521 - RNA, 20 nt, artificial sequence
  siRNA Antisense Sequence
uuguccuuguccuuggugcu

SEQ ID NO: 1522 - RNA, 20 nt, artificial sequence
  siRNA Antisense Sequence
gcaguugucauuguccuugu

SEQ ID NO: 1523 - RNA, 20 nt, artificial sequence
  siRNA Antisense Sequence
ccaagcaguugucauugucc

SEQ ID NO: 1524 - RNA, 20 nt, artificial sequence
  siRNA Antisense Sequence
uccaagcaguugucauuguc

SEQ ID NO: 1525 - RNA, 20 nt, artificial sequence
  siRNA Antisense Sequence
uguccaagcaguugucauug

SEQ ID NO: 1526 - RNA, 20 nt, artificial sequence
  siRNA Antisense Sequence
uuguccaagcaguugucauu

SEQ ID NO: 1527 - RNA, 20 nt, artificial sequence
  siRNA Antisense Sequence
cuuguccaagcaguugucau

SEQ ID NO: 1528 - RNA, 20 nt, artificial sequence
  siRNA Antisense Sequence
acuuguccaagcaguuguca

SEQ ID NO: 1529 - RNA, 20 nt, artificial sequence
  siRNA Antisense Sequence
cacuuguccaagcaguuguc

SEQ ID NO: 1530 - RNA, 20 nt, artificial sequence
  siRNA Antisense Sequence
acacuuguccaagcaguugu

SEQ ID NO: 1531 - RNA, 20 nt, artificial sequence
  siRNA Antisense Sequence
cacacuuguccaagcaguug

SEQ ID NO: 1532 - RNA, 20 nt, artificial sequence
  siRNA Antisense Sequence
gcacacuuguccaagcaguu

SEQ ID NO: 1533 - RNA, 20 nt, artificial sequence
  siRNA Antisense Sequence
ugcacacuuguccaagcagu

SEQ ID NO: 1534 - RNA, 20 nt, artificial sequence
  siRNA Antisense Sequence
caccuuugcggagcugugca

SEQ ID NO: 1535 - RNA, 20 nt, artificial sequence
  siRNA Antisense Sequence
ucaccuuugcggagcugugc

SEQ ID NO: 1536 - RNA, 20 nt, artificial sequence
  siRNA Antisense Sequence
cucaccuuugcggagcugug

SEQ ID NO: 1537 - RNA, 20 nt, artificial sequence
  siRNA Antisense Sequence
ucucaccuuugcggagcugu

SEQ ID NO: 1538 - RNA, 20 nt, artificial sequence
  siRNA Antisense Sequence
aucucaccuuugcggagcug

SEQ ID NO: 1539 - RNA, 20 nt, artificial sequence
  siRNA Antisense Sequence
aaucucaccuuugcggagcu

SEQ ID NO: 1540 - RNA, 20 nt, artificial sequence
  siRNA Antisense Sequence
aaaucucaccuuugcggagc

SEQ ID NO: 1541 - RNA, 20 nt, artificial sequence
  siRNA Antisense Sequence
agcuuguaccugaacuucuc

SEQ ID NO: 1542 - RNA, 20 nt, artificial sequence
  siRNA Antisense Sequence
gagcuuguaccugaacuucu

SEQ ID NO: 1543 - RNA, 20 nt, artificial sequence
  siRNA Antisense Sequence
ugagcuuguaccugaacuuc

SEQ ID NO: 1544 - RNA, 20 nt, artificial sequence
  siRNA Antisense Sequence
uaugagcuuguaccugaacu

SEQ ID NO: 1545 - RNA, 20 nt, artificial sequence
  siRNA Antisense Sequence
uuaugagcuuguaccugaac

SEQ ID NO: 1546 - RNA, 20 nt, artificial sequence
  siRNA Antisense Sequence
ggauuaugagcuuguaccug

SEQ ID NO: 1547 - RNA, 20 nt, artificial sequence
  siRNA Antisense Sequence
gggauuaugagcuuguaccu

SEQ ID NO: 1548 - RNA, 20 nt, artificial sequence
  siRNA Antisense Sequence
ugggauuaugagcuuguacc

SEQ ID NO: 1549 - RNA, 20 nt, artificial sequence
  siRNA Antisense Sequence
gugggauuaugagcuuguac

SEQ ID NO: 1550 - RNA, 20 nt, artificial sequence
  siRNA Antisense Sequence
agugggauuaugagcuugua

SEQ ID NO: 1551 - RNA, 20 nt, artificial sequence
  siRNA Antisense Sequence
ucaagugggauuaugagcuu

SEQ ID NO: 1552 - RNA, 20 nt, artificial sequence
  siRNA Antisense Sequence
cucuuucuccucaaguggga

SEQ ID NO: 1553 - RNA, 20 nt, artificial sequence
  siRNA Antisense Sequence
aaccggaauaucaacuguac

SEQ ID NO: 1554 - RNA, 20 nt, artificial sequence
  siRNA Antisense Sequence
caaaaccggaauaucaacug

SEQ ID NO: 1555 - RNA, 20 nt, artificial sequence
  siRNA Antisense Sequence
ccaaaaccggaauaucaacu

SEQ ID NO: 1556 - RNA, 20 nt, artificial sequence
  siRNA Antisense Sequence
accaaaaccggaauaucaac

SEQ ID NO: 1557 - RNA, 20 nt, artificial sequence
  siRNA Antisense Sequence
gaaagaauaccaaaaccgga

SEQ ID NO: 1558 - RNA, 20 nt, artificial sequence
  siRNA Antisense Sequence
gggucagaaagaauaccaaa

SEQ ID NO: 1559 - RNA, 20 nt, artificial sequence
  siRNA Antisense Sequence
agggucagaaagaauaccaa

SEQ ID NO: 1560 - RNA, 20 nt, artificial sequence
  siRNA Antisense Sequence
accagacaucagguaaggag

SEQ ID NO: 1561 - RNA, 20 nt, artificial sequence
  siRNA Antisense Sequence
gaccagacaucagguaagga

SEQ ID NO: 1562 - RNA, 20 nt, artificial sequence
  siRNA Antisense Sequence
agaccagacaucagguaagg

SEQ ID NO: 1563 - RNA, 20 nt, artificial sequence
  siRNA Antisense Sequence
auagaccagacaucagguaa

SEQ ID NO: 1564 - RNA, 20 nt, artificial sequence
  siRNA Antisense Sequence
gauagaccagacaucaggua

SEQ ID NO: 1565 - RNA, 20 nt, artificial sequence
  siRNA Antisense Sequence
acugugauagaccagacauc

SEQ ID NO: 1566 - RNA, 20 nt, artificial sequence
  siRNA Antisense Sequence
gacugugauagaccagacau

SEQ ID NO: 1567 - RNA, 20 nt, artificial sequence
  siRNA Antisense Sequence
ugacugugauagaccagaca

SEQ ID NO: 1568 - RNA, 20 nt, artificial sequence
  siRNA Antisense Sequence
uugacugugauagaccagac

SEQ ID NO: 1569 - RNA, 20 nt, artificial sequence
  siRNA Antisense Sequence
guugacugugauagaccaga

SEQ ID NO: 1570 - RNA, 20 nt, artificial sequence
  siRNA Antisense Sequence
aguugacugugauagaccag

SEQ ID NO: 1571 - RNA, 20 nt, artificial sequence
  siRNA Antisense Sequence
aaguugacugugauagacca

SEQ ID NO: 1572 - RNA, 20 nt, artificial sequence
  siRNA Antisense Sequence
gcuaguaaguugacugugau

SEQ ID NO: 1573 - RNA, 20 nt, artificial sequence
  siRNA Antisense Sequence
ugcuaguaaguugacuguga

SEQ ID NO: 1574 - RNA, 20 nt, artificial sequence
  siRNA Antisense Sequence
gugcuaguaaguugacugug

SEQ ID NO: 1575 - RNA, 20 nt, artificial sequence
  siRNA Antisense Sequence
agugcuaguaaguugacugu

SEQ ID NO: 1576 - RNA, 20 nt, artificial sequence
  siRNA Antisense Sequence
gacccagugcuaguaaguug

SEQ ID NO: 1577 - RNA, 20 nt, artificial sequence
  siRNA Antisense Sequence
agacccagugcuaguaaguu

SEQ ID NO: 1578 - RNA, 20 nt, artificial sequence
  siRNA Antisense Sequence
cagacccagugcuaguaagu

SEQ ID NO: 1579 - RNA, 20 nt, artificial sequence
  siRNA Antisense Sequence
acagacccagugcuaguaag

SEQ ID NO: 1580 - RNA, 20 nt, artificial sequence
  siRNA Antisense Sequence
aacagacccagugcuaguaa

SEQ ID NO: 1581 - RNA, 20 nt, artificial sequence
  siRNA Antisense Sequence
aaacagacccagugcuagua

SEQ ID NO: 1582 - RNA, 20 nt, artificial sequence
  siRNA Antisense Sequence
gaaacagacccagugcuagu

SEQ ID NO: 1583 - RNA, 20 nt, artificial sequence
  siRNA Antisense Sequence
caugagaaacagacccagug

SEQ ID NO: 1584 - RNA, 20 nt, artificial sequence
  siRNA Antisense Sequence
gccaccuggcaugagaaaca

SEQ ID NO: 1585 - RNA, 20 nt, artificial sequence
  siRNA Antisense Sequence
agccaccuggcaugagaaac

SEQ ID NO: 1586 - RNA, 20 nt, artificial sequence
  siRNA Antisense Sequence
uagccaccuggcaugagaaa

SEQ ID NO: 1587 - RNA, 20 nt, artificial sequence
  siRNA Antisense Sequence
aguagccaccuggcaugaga

SEQ ID NO: 1588 - RNA, 20 nt, artificial sequence
  siRNA Antisense Sequence
caguagccaccuggcaugag

SEQ ID NO: 1589 - RNA, 20 nt, artificial sequence
  siRNA Antisense Sequence
guuguaccaguagccaccug

SEQ ID NO: 1590 - RNA, 20 nt, artificial sequence
  siRNA Antisense Sequence
aguuguaccaguagccaccu

SEQ ID NO: 1591 - RNA, 20 nt, artificial sequence
  siRNA Antisense Sequence
cagcaguuguaccaguagcc

SEQ ID NO: 1592 - RNA, 20 nt, artificial sequence
  siRNA Antisense Sequence
gcagcaguuguaccaguagc

SEQ ID NO: 1593 - RNA, 20 nt, artificial sequence
  siRNA Antisense Sequence
gugcagcaguuguaccagua

SEQ ID NO: 1594 - RNA, 20 nt, artificial sequence
  siRNA Antisense Sequence
ugugcagcaguuguaccagu

SEQ ID NO: 1595 - RNA, 20 nt, artificial sequence
  siRNA Antisense Sequence
cugugcagcaguuguaccag

SEQ ID NO: 1596 - RNA, 20 nt, artificial sequence
  siRNA Antisense Sequence
ucugugcagcaguuguacca

SEQ ID NO: 1597 - RNA, 20 nt, artificial sequence
  siRNA Antisense Sequence
gucugugcagcaguuguacc

SEQ ID NO: 1598 - RNA, 20 nt, artificial sequence
  siRNA Antisense Sequence
agucugugcagcaguuguac

SEQ ID NO: 1599 - RNA, 20 nt, artificial sequence
  siRNA Antisense Sequence
gagucugugcagcaguugua

SEQ ID NO: 1600 - RNA, 20 nt, artificial sequence
  siRNA Antisense Sequence
ggagucugugcagcaguugu

SEQ ID NO: 1601 - RNA, 20 nt, artificial sequence
  siRNA Antisense Sequence
uuggagucugugcagcaguu

SEQ ID NO: 1602 - RNA, 20 nt, artificial sequence
  siRNA Antisense Sequence
guuggagucugugcagcagu

SEQ ID NO: 1603 - RNA, 20 nt, artificial sequence
  siRNA Antisense Sequence
gagguuggagucugugcagc

SEQ ID NO: 1604 - RNA, 20 nt, artificial sequence
  siRNA Antisense Sequence
auugagguuggagucugugc

SEQ ID NO: 1605 - RNA, 20 nt, artificial sequence
  siRNA Antisense Sequence
cauugagguuggagucugug

SEQ ID NO: 1606 - RNA, 20 nt, artificial sequence
  siRNA Antisense Sequence
ccauugagguuggagucugu

SEQ ID NO: 1607 - RNA, 20 nt, artificial sequence
  siRNA Antisense Sequence
guacacuccauugagguugg

SEQ ID NO: 1608 - RNA, 20 nt, artificial sequence
  siRNA Antisense Sequence
uaguacacuccauugagguu

SEQ ID NO: 1609 - RNA, 20 nt, artificial sequence
  siRNA Antisense Sequence
gguaguacacuccauugagg

SEQ ID NO: 1610 - RNA, 20 nt, artificial sequence
  siRNA Antisense Sequence
cgguaguacacuccauugag

SEQ ID NO: 1611 - RNA, 20 nt, artificial sequence
  siRNA Antisense Sequence
gcgguaguacacuccauuga

SEQ ID NO: 1612 - RNA, 20 nt, artificial sequence
  siRNA Antisense Sequence
ggcgguaguacacuccauug

SEQ ID NO: 1613 - RNA, 20 nt, artificial sequence
  siRNA Antisense Sequence
aggcgguaguacacuccauu

SEQ ID NO: 1614 - RNA, 20 nt, artificial sequence
  siRNA Antisense Sequence
caggcgguaguacacuccau

SEQ ID NO: 1615 - RNA, 20 nt, artificial sequence
  siRNA Antisense Sequence
ccaggcgguaguacacucca

SEQ ID NO: 1616 - RNA, 20 nt, artificial sequence
  siRNA Antisense Sequence
cucacccaggcgguaguaca

SEQ ID NO: 1617 - RNA, 20 nt, artificial sequence
  siRNA Antisense Sequence
ugcucacccaggcgguagua

SEQ ID NO: 1618 - RNA, 20 nt, artificial sequence
  siRNA Antisense Sequence
gcuuauugugcucacccagg

SEQ ID NO: 1619 - RNA, 20 nt, artificial sequence
  siRNA Antisense Sequence
ugcuuauugugcucacccag

SEQ ID NO: 1620 - RNA, 20 nt, artificial sequence
  siRNA Antisense Sequence
gugcuuauugugcucaccca

SEQ ID NO: 1621 - RNA, 20 nt, artificial sequence
  siRNA Antisense Sequence
ccaggugcuuauugugcuca

SEQ ID NO: 1622 - RNA, 20 nt, artificial sequence
  siRNA Antisense Sequence
uccaggugcuuauugugcuc

SEQ ID NO: 1623 - RNA, 20 nt, artificial sequence
  siRNA Antisense Sequence
ccauccaggugcuuauugug

SEQ ID NO: 1624 - RNA, 20 nt, artificial sequence
  siRNA Antisense Sequence
gccauccaggugcuuauugu

SEQ ID NO: 1625 - RNA, 20 nt, artificial sequence
  siRNA Antisense Sequence
ugccauccaggugcuuauug

SEQ ID NO: 1626 - RNA, 20 nt, artificial sequence
  siRNA Antisense Sequence
augccauccaggugcuuauu

SEQ ID NO: 1627 - RNA, 20 nt, artificial sequence
  siRNA Antisense Sequence
gaugccauccaggugcuuau

SEQ ID NO: 1628 - RNA, 20 nt, artificial sequence
  siRNA Antisense Sequence
ugaugccauccaggugcuua

SEQ ID NO: 1629 - RNA, 20 nt, artificial sequence
  siRNA Antisense Sequence
accaggugaugccauccagg

SEQ ID NO: 1630 - RNA, 20 nt, artificial sequence
  siRNA Antisense Sequence
uaccaggugaugccauccag

SEQ ID NO: 1631 - RNA, 20 nt, artificial sequence
  siRNA Antisense Sequence
uagguagauccaugccagcc

SEQ ID NO: 1632 - RNA, 20 nt, artificial sequence
  siRNA Antisense Sequence
guagguagauccaugccagc

SEQ ID NO: 1633 - RNA, 20 nt, artificial sequence
  siRNA Antisense Sequence
gaguagguagauccaugcca

SEQ ID NO: 1634 - RNA, 20 nt, artificial sequence
  siRNA Antisense Sequence
ggaguagguagauccaugcc

SEQ ID NO: 1635 - RNA, 20 nt, artificial sequence
  siRNA Antisense Sequence
gggaguagguagauccaugc

SEQ ID NO: 1636 - RNA, 20 nt, artificial sequence
  siRNA Antisense Sequence
agggaguagguagauccaug

SEQ ID NO: 1637 - RNA, 20 nt, artificial sequence
  siRNA Antisense Sequence
gagggaguagguagauccau

SEQ ID NO: 1638 - RNA, 20 nt, artificial sequence
  siRNA Antisense Sequence
ugagggaguagguagaucca

SEQ ID NO: 1639 - RNA, 20 nt, artificial sequence
  siRNA Antisense Sequence
uugagggaguagguagaucc

SEQ ID NO: 1640 - RNA, 20 nt, artificial sequence
  siRNA Antisense Sequence
uuugagggaguagguagauc

SEQ ID NO: 1641 - RNA, 20 nt, artificial sequence
  siRNA Antisense Sequence
cguuugagggaguagguaga

SEQ ID NO: 1642 - RNA, 20 nt, artificial sequence
  siRNA Antisense Sequence
ccguuugagggaguagguag

SEQ ID NO: 1643 - RNA, 20 nt, artificial sequence
  siRNA Antisense Sequence
cccguuugagggaguaggua

SEQ ID NO: 1644 - RNA, 20 nt, artificial sequence
  siRNA Antisense Sequence
acccguuugagggaguaggu

SEQ ID NO: 1645 - RNA, 20 nt, artificial sequence
  siRNA Antisense Sequence
cacccguuugagggaguagg

SEQ ID NO: 1646 - RNA, 20 nt, artificial sequence
  siRNA Antisense Sequence
ccacccguuugagggaguag

SEQ ID NO: 1647 - RNA, 20 nt, artificial sequence
  siRNA Antisense Sequence
uccacccguuugagggagua

SEQ ID NO: 1648 - RNA, 20 nt, artificial sequence
  siRNA Antisense Sequence
aucuccacccguuugaggga

SEQ ID NO: 1649 - RNA, 20 nt, artificial sequence
  siRNA Antisense Sequence
caucuccacccguuugaggg

SEQ ID NO: 1650 - RNA, 20 nt, artificial sequence
  siRNA Antisense Sequence
ucaucuccacccguuugagg

SEQ ID NO: 1651 - RNA, 20 nt, artificial sequence
  siRNA Antisense Sequence
uucaucuccacccguuugag

SEQ ID NO: 1652 - RNA, 20 nt, artificial sequence
  siRNA Antisense Sequence
uuucaucuccacccguuuga

SEQ ID NO: 1653 - RNA, 20 nt, artificial sequence
  siRNA Antisense Sequence
uuuucaucuccacccguuug

SEQ ID NO: 1654 - RNA, 20 nt, artificial sequence
  siRNA Antisense Sequence
auuuucaucuccacccguuu

SEQ ID NO: 1655 - RNA, 20 nt, artificial sequence
  siRNA Antisense Sequence
ggcggauuuucaucuccacc

SEQ ID NO: 1656 - RNA, 20 nt, artificial sequence
  siRNA Antisense Sequence
ggcuugaagucuucugggcg

SEQ ID NO: 1657 - RNA, 20 nt, artificial sequence
  siRNA Antisense Sequence
aaggcuugaagucuucuggg

SEQ ID NO: 1658 - RNA, 20 nt, artificial sequence
  siRNA Antisense Sequence
ccuuuuaaggcuugaagucu

SEQ ID NO: 1659 - RNA, 20 nt, artificial sequence
  siRNA Antisense Sequence
cuccuuuuaaggcuugaagu

SEQ ID NO: 1660 - RNA, 20 nt, artificial sequence
  siRNA Antisense Sequence
ccuccuuuuaaggcuugaag

SEQ ID NO: 1661 - RNA, 20 nt, artificial sequence
  siRNA Antisense Sequence
acggcagccuccuuuuaagg

SEQ ID NO: 1662 - RNA, 20 nt, artificial sequence
  siRNA Antisense Sequence
cacggcagccuccuuuuaag

SEQ ID NO: 1663 - RNA, 20 nt, artificial sequence
  siRNA Antisense Sequence
cuccacggcagccuccuuuu

SEQ ID NO: 1664 - RNA, 20 nt, artificial sequence
  siRNA Antisense Sequence
uuucuguauccgugcuccac

SEQ ID NO: 1665 - RNA, 20 nt, artificial sequence
  siRNA Antisense Sequence
aguuucuguauccgugcucc

SEQ ID NO: 1666 - RNA, 20 nt, artificial sequence
  siRNA Antisense Sequence
caguuucuguauccgugcuc

SEQ ID NO: 1667 - RNA, 20 nt, artificial sequence
  siRNA Antisense Sequence
cucaguuucuguauccgugc

SEQ ID NO: 1668 - RNA, 20 nt, artificial sequence
  siRNA Antisense Sequence
ugucucaguuucuguauccg

SEQ ID NO: 1669 - RNA, 20 nt, artificial sequence
  siRNA Antisense Sequence
ugcccucauccagucuccac

SEQ ID NO: 1670 - RNA, 20 nt, artificial sequence
  siRNA Antisense Sequence
aucugcccucauccagucuc

SEQ ID NO: 1671 - RNA, 20 nt, artificial sequence
  siRNA Antisense Sequence
caucugcccucauccagucu

SEQ ID NO: 1672 - RNA, 20 nt, artificial sequence
  siRNA Antisense Sequence
ucaucugcccucauccaguc

SEQ ID NO: 1673 - RNA, 20 nt, artificial sequence
  siRNA Antisense Sequence
ccucaucugcccucauccag

SEQ ID NO: 1674 - RNA, 20 nt, artificial sequence
  siRNA Antisense Sequence
cuaacacucucuuccugucc

SEQ ID NO: 1675 - RNA, 20 nt, artificial sequence
  siRNA Antisense Sequence
ucuaacacucucuuccuguc

SEQ ID NO: 1676 - RNA, 20 nt, artificial sequence
  siRNA Antisense Sequence
uucuaacacucucuuccugu

SEQ ID NO: 1677 - RNA, 20 nt, artificial sequence
  siRNA Antisense Sequence
uauaggcuguuucucagucc

SEQ ID NO: 1678 - RNA, 20 nt, artificial sequence
  siRNA Antisense Sequence
ccuuggagacuuauucuuuc

SEQ ID NO: 1679 - RNA, 20 nt, artificial sequence
  siRNA Antisense Sequence
gcuccuuggagacuuauucu

SEQ ID NO: 1680 - RNA, 20 nt, artificial sequence
  siRNA Antisense Sequence
ugcuccuuggagacuuauuc

SEQ ID NO: 1681 - RNA, 20 nt, artificial sequence
  siRNA Antisense Sequence
uuuugugcuccuuggagacu

SEQ ID NO: 1682 - RNA, 20 nt, artificial sequence
  siRNA Antisense Sequence
agcuugagucucugacaggg

SEQ ID NO: 1683 - RNA, 20 nt, artificial sequence
  siRNA Antisense Sequence
uuuucucucuuuccuugcuc

SEQ ID NO: 1684 - RNA, 20 nt, artificial sequence
  siRNA Antisense Sequence
ccucgccacuuuguuguuuu

SEQ ID NO: 1685 - RNA, 20 nt, artificial sequence
  siRNA Antisense Sequence
gccucgccacuuuguuguuu

SEQ ID NO: 1686 - RNA, 20 nt, artificial sequence
  siRNA Antisense Sequence
ggccucgccacuuuguuguu

SEQ ID NO: 1687 - RNA, 20 nt, artificial sequence
  siRNA Antisense Sequence
gggccucgccacuuuguugu

SEQ ID NO: 1688 - RNA, 20 nt, artificial sequence
  siRNA Antisense Sequence
agggccucgccacuuuguug

SEQ ID NO: 1689 - RNA, 20 nt, artificial sequence
  siRNA Antisense Sequence
gagggccucgccacuuuguu

SEQ ID NO: 1690 - RNA, 20 nt, artificial sequence
  siRNA Antisense Sequence
ugagggccucgccacuuugu

SEQ ID NO: 1691 - RNA, 20 nt, artificial sequence
  siRNA Antisense Sequence
ucugagggccucgccacuuu

SEQ ID NO: 1692 - RNA, 20 nt, artificial sequence
  siRNA Antisense Sequence
uuucacucugagggccucgc

SEQ ID NO: 1693 - RNA, 20 nt, artificial sequence
  siRNA Antisense Sequence
cgcuuucacucugagggccu

SEQ ID NO: 1694 - RNA, 20 nt, artificial sequence
  siRNA Antisense Sequence
uacgcuuucacucugagggc

SEQ ID NO: 1695 - RNA, 20 nt, artificial sequence
  siRNA Antisense Sequence
uuacgcuuucacucugaggg

SEQ ID NO: 1696 - RNA, 20 nt, artificial sequence
  siRNA Antisense Sequence
cuuacgcuuucacucugagg

SEQ ID NO: 1697 - RNA, 20 nt, artificial sequence
  siRNA Antisense Sequence
ccuuacgcuuucacucugag

SEQ ID NO: 1698 - RNA, 20 nt, artificial sequence
  siRNA Antisense Sequence
aaccuuacgcuuucacucug

SEQ ID NO: 1699 - RNA, 20 nt, artificial sequence
  siRNA Antisense Sequence
gaaccuuacgcuuucacucu

SEQ ID NO: 1700 - RNA, 20 nt, artificial sequence
  siRNA Antisense Sequence
ugacugaaccuuacgcuuuc

SEQ ID NO: 1701 - RNA, 20 nt, artificial sequence
  siRNA Antisense Sequence
cugacugaaccuuacgcuuu

SEQ ID NO: 1702 - RNA, 20 nt, artificial sequence
  siRNA Antisense Sequence
gcugacugaaccuuacgcuu

SEQ ID NO: 1703 - RNA, 20 nt, artificial sequence
  siRNA Antisense Sequence
ggcugacugaaccuuacgcu

SEQ ID NO: 1704 - RNA, 20 nt, artificial sequence
  siRNA Antisense Sequence
aggcugacugaaccuuacgc

SEQ ID NO: 1705 - RNA, 20 nt, artificial sequence
  siRNA Antisense Sequence
gguuugggugaggaaggcuc

SEQ ID NO: 1706 - RNA, 20 nt, artificial sequence
  siRNA Antisense Sequence
ggguuugggugaggaaggcu

SEQ ID NO: 1707 - RNA, 20 nt, artificial sequence
  siRNA Antisense Sequence
uguggguuugggugaggaag

SEQ ID NO: 1708 - RNA, 20 nt, artificial sequence
  siRNA Antisense Sequence
uuguggguuugggugaggaa

SEQ ID NO: 1709 - RNA, 20 nt, artificial sequence
  siRNA Antisense Sequence
uuuuguggguuugggugagg

SEQ ID NO: 1710 - RNA, 20 nt, artificial sequence
  siRNA Antisense Sequence
gaaaaugcagagccagguca

SEQ ID NO: 1711 - RNA, 20 nt, artificial sequence
  siRNA Antisense Sequence
ccacgaugaaaaugcagagc

SEQ ID NO: 1712 - RNA, 20 nt, artificial sequence
  siRNA Antisense Sequence
gccacgaugaaaaugcagag

SEQ ID NO: 1713 - RNA, 20 nt, artificial sequence
  siRNA Antisense Sequence
aggccacgaugaaaaugcag

SEQ ID NO: 1714 - RNA, 20 nt, artificial sequence
  siRNA Antisense Sequence
aaaggccacgaugaaaaugc

SEQ ID NO: 1715 - RNA, 20 nt, artificial sequence
  siRNA Antisense Sequence
acaaaggccacgaugaaaau

SEQ ID NO: 1716 - RNA, 20 nt, artificial sequence
  siRNA Antisense Sequence
ugacaaaggccacgaugaaa

SEQ ID NO: 1717 - RNA, 20 nt, artificial sequence
  siRNA Antisense Sequence
cugacaaaggccacgaugaa

SEQ ID NO: 1718 - RNA, 20 nt, artificial sequence
  siRNA Antisense Sequence
gcugacaaaggccacgauga

SEQ ID NO: 1719 - RNA, 20 nt, artificial sequence
  siRNA Antisense Sequence
ggcugacaaaggccacgaug

SEQ ID NO: 1720 - RNA, 20 nt, artificial sequence
  siRNA Antisense Sequence
acgcuggguggcugacaaag

SEQ ID NO: 1721 - RNA, 20 nt, artificial sequence
  siRNA Antisense Sequence
gugcuuagagagcuucugca

SEQ ID NO: 1722 - RNA, 20 nt, artificial sequence
  siRNA Antisense Sequence
ugugcuuagagagcuucugc

SEQ ID NO: 1723 - RNA, 20 nt, artificial sequence
  siRNA Antisense Sequence
uugugcuuagagagcuucug

SEQ ID NO: 1724 - RNA, 20 nt, artificial sequence
  siRNA Antisense Sequence
ucuugugcuuagagagcuuc

SEQ ID NO: 1725 - RNA, 20 nt, artificial sequence
  siRNA Antisense Sequence
gucuugugcuuagagagcuu

SEQ ID NO: 1726 - RNA, 20 nt, artificial sequence
  siRNA Antisense Sequence
ugucuugugcuuagagagcu

SEQ ID NO: 1727 - RNA, 20 nt, artificial sequence
  siRNA Antisense Sequence
gugucuugugcuuagagagc

SEQ ID NO: 1728 - RNA, 20 nt, artificial sequence
  siRNA Antisense Sequence
ggugucuugugcuuagagag

SEQ ID NO: 1729 - RNA, 20 nt, artificial sequence
  siRNA Antisense Sequence
cuggugucuugugcuuagag

SEQ ID NO: 1730 - RNA, 20 nt, artificial sequence
  siRNA Antisense Sequence
gcuggugucuugugcuuaga

SEQ ID NO: 1731 - RNA, 20 nt, artificial sequence
  siRNA Antisense Sequence
ugugcuggugucuugugcuu

SEQ ID NO: 1732 - RNA, 20 nt, artificial sequence
  siRNA Antisense Sequence
cugugcuggugucuugugcu

SEQ ID NO: 1733 - RNA, 20 nt, artificial sequence
  siRNA Antisense Sequence
ggcugugcuggugucuugug

SEQ ID NO: 1734 - RNA, 20 nt, artificial sequence
  siRNA Antisense Sequence
cgcuuugagcuguggcugug

SEQ ID NO: 1735 - RNA, 20 nt, artificial sequence
  siRNA Antisense Sequence
ccgcuuugagcuguggcugu

SEQ ID NO: 1736 - RNA, 20 nt, artificial sequence
  siRNA Antisense Sequence
accuccucacagcaguuggc

SEQ ID NO: 1737 - RNA, 20 nt, artificial sequence
  siRNA Antisense Sequence
ucaccuccucacagcaguug

SEQ ID NO: 1738 - RNA, 20 nt, artificial sequence
  siRNA Antisense Sequence
guuggcaacuugggccuuga

SEQ ID NO: 1739 - RNA, 20 nt, artificial sequence
  siRNA Antisense Sequence
gguuggcaacuugggccuug

SEQ ID NO: 1740 - RNA, 20 nt, artificial sequence
  siRNA Antisense Sequence
agguuggcaacuugggccuu

SEQ ID NO: 1741 - RNA, 20 nt, artificial sequence
  siRNA Antisense Sequence
aagguuggcaacuugggccu

SEQ ID NO: 1742 - RNA, 20 nt, artificial sequence
  siRNA Antisense Sequence
uaagguuggcaacuugggcc

SEQ ID NO: 1743 - RNA, 20 nt, artificial sequence
  siRNA Antisense Sequence
cuaagguuggcaacuugggc

SEQ ID NO: 1744 - RNA, 20 nt, artificial sequence
  siRNA Antisense Sequence
gcuaagguuggcaacuuggg

SEQ ID NO: 1745 - RNA, 20 nt, artificial sequence
  siRNA Antisense Sequence
ugcuaagguuggcaacuugg

SEQ ID NO: 1746 - RNA, 20 nt, artificial sequence
  siRNA Antisense Sequence
cugcuaagguuggcaacuug

SEQ ID NO: 1747 - RNA, 20 nt, artificial sequence
  siRNA Antisense Sequence
gcugcuaagguuggcaacuu

SEQ ID NO: 1748 - RNA, 20 nt, artificial sequence
  siRNA Antisense Sequence
ggcugcuaagguuggcaacu

SEQ ID NO: 1749 - RNA, 20 nt, artificial sequence
  siRNA Antisense Sequence
aggcugcuaagguuggcaac

SEQ ID NO: 1750 - RNA, 20 nt, artificial sequence
  siRNA Antisense Sequence
caggcugcuaagguuggcaa

SEQ ID NO: 1751 - RNA, 20 nt, artificial sequence
  siRNA Antisense Sequence
caguucacucagcaggcugc

SEQ ID NO: 1752 - RNA, 20 nt, artificial sequence
  siRNA Antisense Sequence
ucaguucacucagcaggcug

SEQ ID NO: 1753 - RNA, 20 nt, artificial sequence
  siRNA Antisense Sequence
uucaguucacucagcaggcu

SEQ ID NO: 1754 - RNA, 20 nt, artificial sequence
  siRNA Antisense Sequence
guucaguucacucagcaggc

SEQ ID NO: 1755 - RNA, 20 nt, artificial sequence
  siRNA Antisense Sequence
cuuguucaguucacucagca

SEQ ID NO: 1756 - RNA, 20 nt, artificial sequence
  siRNA Antisense Sequence
ucuuguucaguucacucagc

SEQ ID NO: 1757 - RNA, 20 nt, artificial sequence
  siRNA Antisense Sequence
uucuuguucaguucacucag

SEQ ID NO: 1758 - RNA, 20 nt, artificial sequence
  siRNA Antisense Sequence
gucccucuccugcuucuugu

SEQ ID NO: 1759 - RNA, 20 nt, artificial sequence
  siRNA Antisense Sequence
augaccacgcugacccaguc

SEQ ID NO: 1760 - RNA, 20 nt, artificial sequence
  siRNA Antisense Sequence
ugcaugaccacgcugaccca

SEQ ID NO: 1761 - RNA, 20 nt, artificial sequence
  siRNA Antisense Sequence
accugcaugaccacgcugac

SEQ ID NO: 1762 - RNA, 20 nt, artificial sequence
  siRNA Antisense Sequence
caccugcaugaccacgcuga

SEQ ID NO: 1763 - RNA, 20 nt, artificial sequence
  siRNA Antisense Sequence
ucaccugcaugaccacgcug

SEQ ID NO: 1764 - RNA, 20 nt, artificial sequence
  siRNA Antisense Sequence
aucaccugcaugaccacgcu

SEQ ID NO: 1765 - RNA, 20 nt, artificial sequence
  siRNA Antisense Sequence
cuccaucaccugcaugacca

SEQ ID NO: 1766 - RNA, 20 nt, artificial sequence
  siRNA Antisense Sequence
cgcuugcuguugcucuccag

SEQ ID NO: 1767 - RNA, 20 nt, artificial sequence
  siRNA Antisense Sequence
gcgcuugcuguugcucucca

SEQ ID NO: 1768 - RNA, 20 nt, artificial sequence
  siRNA Antisense Sequence
caugcgcuugcuguugcucu

SEQ ID NO: 1769 - RNA, 20 nt, artificial sequence
  siRNA Antisense Sequence
ccaugcgcuugcuguugcuc

SEQ ID NO: 1770 - RNA, 20 nt, artificial sequence
  siRNA Antisense Sequence
uccaugcgcuugcuguugcu

SEQ ID NO: 1771 - RNA, 20 nt, artificial sequence
  siRNA Antisense Sequence
cuccaugcgcuugcuguugc

SEQ ID NO: 1772 - RNA, 20 nt, artificial sequence
  siRNA Antisense Sequence
acuccaugcgcuugcuguug

SEQ ID NO: 1773 - RNA, 20 nt, artificial sequence
  siRNA Antisense Sequence
gacuccaugcgcuugcuguu

SEQ ID NO: 1774 - RNA, 20 nt, artificial sequence
  siRNA Antisense Sequence
cgacuccaugcgcuugcugu

SEQ ID NO: 1775 - RNA, 20 nt, artificial sequence
  siRNA Antisense Sequence
gguuguucaucucggaguac

SEQ ID NO: 1776 - RNA, 20 nt, artificial sequence
  siRNA Antisense Sequence
ugguuguucaucucggagua

SEQ ID NO: 1777 - RNA, 20 nt, artificial sequence
  siRNA Antisense Sequence
uugguuguucaucucggagu

SEQ ID NO: 1778 - RNA, 20 nt, artificial sequence
  siRNA Antisense Sequence
gcaugaugucaauuugguug

SEQ ID NO: 1779 - RNA, 20 nt, artificial sequence
  siRNA Antisense Sequence
agcugcaugaugucaauuug

SEQ ID NO: 1780 - RNA, 20 nt, artificial sequence
  siRNA Antisense Sequence
agugaccgucugugcugccu

SEQ ID NO: 1781 - RNA, 20 nt, artificial sequence
  siRNA Antisense Sequence
ugagugaccgucugugcugc

SEQ ID NO: 1782 - RNA, 20 nt, artificial sequence
  siRNA Antisense Sequence
cugagugaccgucugugcug

SEQ ID NO: 1783 - RNA, 20 nt, artificial sequence
  siRNA Antisense Sequence
ucugagugaccgucugugcu

SEQ ID NO: 1784 - RNA, 20 nt, artificial sequence
  siRNA Antisense Sequence
ucugcggaggucugagugac

SEQ ID NO: 1785 - RNA, 20 nt, artificial sequence
  siRNA Antisense Sequence
aucugcggaggucugaguga

SEQ ID NO: 1786 - RNA, 20 nt, artificial sequence
  siRNA Antisense Sequence
caucugcggaggucugagug

SEQ ID NO: 1787 - RNA, 20 nt, artificial sequence
  siRNA Antisense Sequence
gcaucugcggaggucugagu

SEQ ID NO: 1788 - RNA, 20 nt, artificial sequence
  siRNA Antisense Sequence
uggcaucugcggaggucuga

SEQ ID NO: 1789 - RNA, 20 nt, artificial sequence
  siRNA Antisense Sequence
auggcaucugcggaggucug

SEQ ID NO: 1790 - RNA, 20 nt, artificial sequence
  siRNA Antisense Sequence
gauggcaucugcggaggucu

SEQ ID NO: 1791 - RNA, 20 nt, artificial sequence
  siRNA Antisense Sequence
gagcagucguagauggcauc

SEQ ID NO: 1792 - RNA, 20 nt, artificial sequence
  siRNA Antisense Sequence
agagcagucguagauggcau

SEQ ID NO: 1793 - RNA, 20 nt, artificial sequence
  siRNA Antisense Sequence
aagagcagucguagauggca

SEQ ID NO: 1794 - RNA, 20 nt, artificial sequence
  siRNA Antisense Sequence
gaagagcagucguagauggc

SEQ ID NO: 1795 - RNA, 20 nt, artificial sequence
  siRNA Antisense Sequence
ggaagagcagucguagaugg

SEQ ID NO: 1796 - RNA, 20 nt, artificial sequence
  siRNA Antisense Sequence
gggaagagcagucguagaug

SEQ ID NO: 1797 - RNA, 20 nt, artificial sequence
  siRNA Antisense Sequence
agggaagagcagucguagau

SEQ ID NO: 1798 - RNA, 20 nt, artificial sequence
  siRNA Antisense Sequence
gagggaagagcagucguaga

SEQ ID NO: 1799 - RNA, 20 nt, artificial sequence
  siRNA Antisense Sequence
gguaguucuucugguagagg

SEQ ID NO: 1800 - RNA, 20 nt, artificial sequence
  siRNA Antisense Sequence
agcuuauacacuccagagau

SEQ ID NO: 1801 - RNA, 20 nt, artificial sequence
  siRNA Antisense Sequence
gaagucaucaggaggaagcu

SEQ ID NO: 1802 - RNA, 20 nt, artificial sequence
  siRNA Antisense Sequence
ggaagucaucaggaggaagc

SEQ ID NO: 1803 - RNA, 20 nt, artificial sequence
  siRNA Antisense Sequence
gcccaggaagucaucaggag

SEQ ID NO: 1804 - RNA, 20 nt, artificial sequence
  siRNA Antisense Sequence
gcugcccaggaagucaucag

SEQ ID NO: 1805 - RNA, 20 nt, artificial sequence
  siRNA Antisense Sequence
aguucagggcugcccaggaa

SEQ ID NO: 1806 - RNA, 20 nt, artificial sequence
  siRNA Antisense Sequence
acaccuccaguucagggcug

SEQ ID NO: 1807 - RNA, 20 nt, artificial sequence
  siRNA Antisense Sequence
aacaccuccaguucagggcu

SEQ ID NO: 1808 - RNA, 20 nt, artificial sequence
  siRNA Antisense Sequence
ccgccugaagucuccauguc

SEQ ID NO: 1809 - RNA, 20 nt, artificial sequence
  siRNA Antisense Sequence
uccgccugaagucuccaugu

SEQ ID NO: 1810 - RNA, 20 nt, artificial sequence
  siRNA Antisense Sequence
cuccgccugaagucuccaug

SEQ ID NO: 1811 - RNA, 20 nt, artificial sequence
  siRNA Antisense Sequence
ccuccgccugaagucuccau

SEQ ID NO: 1812 - RNA, 20 nt, artificial sequence
  siRNA Antisense Sequence
agaaggagacaaggccacuu

SEQ ID NO: 1813 - RNA, 20 nt, artificial sequence
  siRNA Antisense Sequence
uagaaggagacaaggccacu

SEQ ID NO: 1814 - RNA, 20 nt, artificial sequence
  siRNA Antisense Sequence
ucccgguagaaggagacaag

SEQ ID NO: 1815 - RNA, 20 nt, artificial sequence
  siRNA Antisense Sequence
gucccgguagaaggagacaa

SEQ ID NO: 1816 - RNA, 20 nt, artificial sequence
  siRNA Antisense Sequence
agucccgguagaaggagaca

SEQ ID NO: 1817 - RNA, 20 nt, artificial sequence
  siRNA Antisense Sequence
cagucccgguagaaggagac

SEQ ID NO: 1818 - RNA, 20 nt, artificial sequence
  siRNA Antisense Sequence
ccagucccgguagaaggaga

SEQ ID NO: 1819 - RNA, 20 nt, artificial sequence
  siRNA Antisense Sequence
uccagucccgguagaaggag

SEQ ID NO: 1820 - RNA, 20 nt, artificial sequence
  siRNA Antisense Sequence
uuccagucccgguagaagga

SEQ ID NO: 1821 - RNA, 20 nt, artificial sequence
  siRNA Antisense Sequence
ugcuuccagucccgguagaa

SEQ ID NO: 1822 - RNA, 20 nt, artificial sequence
  siRNA Antisense Sequence
cugcuuccagucccgguaga

SEQ ID NO: 1823 - RNA, 20 nt, artificial sequence
  siRNA Antisense Sequence
ccugcuuguacugcuuccag

SEQ ID NO: 1824 - RNA, 20 nt, artificial sequence
  siRNA Antisense Sequence
cccugcuuguacugcuucca

SEQ ID NO: 1825 - RNA, 20 nt, artificial sequence
  siRNA Antisense Sequence
gaugcugccaaagcccugcu

SEQ ID NO: 1826 - RNA, 20 nt, artificial sequence
  siRNA Antisense Sequence
acggaugcugccaaagcccu

SEQ ID NO: 1827 - RNA, 20 nt, artificial sequence
  siRNA Antisense Sequence
cgguggauguguucguuccc

SEQ ID NO: 1828 - RNA, 20 nt, artificial sequence
  siRNA Antisense Sequence
ccgguggauguguucguucc

SEQ ID NO: 1829 - RNA, 20 nt, artificial sequence
  siRNA Antisense Sequence
gccgguggauguguucguuc

SEQ ID NO: 1830 - RNA, 20 nt, artificial sequence
  siRNA Antisense Sequence
agccgguggauguguucguu

SEQ ID NO: 1831 - RNA, 20 nt, artificial sequence
  siRNA Antisense Sequence
gagccgguggauguguucgu

SEQ ID NO: 1832 - RNA, 20 nt, artificial sequence
  siRNA Antisense Sequence
agagccgguggauguguucg

SEQ ID NO: 1833 - RNA, 20 nt, artificial sequence
  siRNA Antisense Sequence
gagagccgguggauguguuc

SEQ ID NO: 1834 - RNA, 20 nt, artificial sequence
  siRNA Antisense Sequence
ggagagccgguggauguguu

SEQ ID NO: 1835 - RNA, 20 nt, artificial sequence
  siRNA Antisense Sequence
uggagagccgguggaugugu

SEQ ID NO: 1836 - RNA, 20 nt, artificial sequence
  siRNA Antisense Sequence
ucuggagagccgguggaugu

SEQ ID NO: 1837 - RNA, 20 nt, artificial sequence
  siRNA Antisense Sequence
ugucuggagagccgguggau

SEQ ID NO: 1838 - RNA, 20 nt, artificial sequence
  siRNA Antisense Sequence
ccaguccuccaucucuacac

SEQ ID NO: 1839 - RNA, 20 nt, artificial sequence
  siRNA Antisense Sequence
ccucccaguccuccaucucu

SEQ ID NO: 1840 - RNA, 20 nt, artificial sequence
  siRNA Antisense Sequence
uugcccucccaguccuccau

SEQ ID NO: 1841 - RNA, 20 nt, artificial sequence
  siRNA Antisense Sequence
acucagcguagcgcagguug

SEQ ID NO: 1842 - RNA, 20 nt, artificial sequence
  siRNA Antisense Sequence
uacucagcguagcgcagguu

SEQ ID NO: 1843 - RNA, 20 nt, artificial sequence
  siRNA Antisense Sequence
uauacucagcguagcgcagg

SEQ ID NO: 1844 - RNA, 20 nt, artificial sequence
  siRNA Antisense Sequence
cuauacucagcguagcgcag

SEQ ID NO: 1845 - RNA, 20 nt, artificial sequence
  siRNA Antisense Sequence
acaaaguggcuauacucagc

SEQ ID NO: 1846 - RNA, 20 nt, artificial sequence
  siRNA Antisense Sequence
aacaaaguggcuauacucag

SEQ ID NO: 1847 - RNA, 20 nt, artificial sequence
  siRNA Antisense Sequence
cauugcccaaaacaaagugg

SEQ ID NO: 1848 - RNA, 20 nt, artificial sequence
  siRNA Antisense Sequence
guugaguucauugcccaaaa

SEQ ID NO: 1849 - RNA, 20 nt, artificial sequence
  siRNA Antisense Sequence
uguugaguucauugcccaaa

SEQ ID NO: 1850 - RNA, 20 nt, artificial sequence
  siRNA Antisense Sequence
cuguugaguucauugcccaa

SEQ ID NO: 1851 - RNA, 20 nt, artificial sequence
  siRNA Antisense Sequence
gcuguugaguucauugccca

SEQ ID NO: 1852 - RNA, 20 nt, artificial sequence
  siRNA Antisense Sequence
cgauagcuguugaguucauu

SEQ ID NO: 1853 - RNA, 20 nt, artificial sequence
  siRNA Antisense Sequence
ggcgauagcuguugaguuca

SEQ ID NO: 1854 - RNA, 20 nt, artificial sequence
  siRNA Antisense Sequence
aggcgauagcuguugaguuc

SEQ ID NO: 1855 - RNA, 20 nt, artificial sequence
  siRNA Antisense Sequence
gaggcgauagcuguugaguu

SEQ ID NO: 1856 - RNA, 20 nt, artificial sequence
  siRNA Antisense Sequence
agaggcgauagcuguugagu

SEQ ID NO: 1857 - RNA, 20 nt, artificial sequence
  siRNA Antisense Sequence
aagaggcgauagcuguugag

SEQ ID NO: 1858 - RNA, 20 nt, artificial sequence
  siRNA Antisense Sequence
gaagaggcgauagcuguuga

SEQ ID NO: 1859 - RNA, 20 nt, artificial sequence
  siRNA Antisense Sequence
ggaagaggcgauagcuguug

SEQ ID NO: 1860 - RNA, 20 nt, artificial sequence
  siRNA Antisense Sequence
aggaagaggcgauagcuguu

SEQ ID NO: 1861 - RNA, 20 nt, artificial sequence
  siRNA Antisense Sequence
caggaagaggcgauagcugu

SEQ ID NO: 1862 - RNA, 20 nt, artificial sequence
  siRNA Antisense Sequence
ccaggaagaggcgauagcug

SEQ ID NO: 1863 - RNA, 20 nt, artificial sequence
  siRNA Antisense Sequence
cccaggaagaggcgauagcu

SEQ ID NO: 1864 - RNA, 20 nt, artificial sequence
  siRNA Antisense Sequence
acauugccaguguaguuccc

SEQ ID NO: 1865 - RNA, 20 nt, artificial sequence
  siRNA Antisense Sequence
cacauugccaguguaguucc

SEQ ID NO: 1866 - RNA, 20 nt, artificial sequence
  siRNA Antisense Sequence
ccacauugccaguguaguuc

SEQ ID NO: 1867 - RNA, 20 nt, artificial sequence
  siRNA Antisense Sequence
cccacauugccaguguaguu

SEQ ID NO: 1868 - RNA, 20 nt, artificial sequence
  siRNA Antisense Sequence
auacuggagggcgucguucc

SEQ ID NO: 1869 - RNA, 20 nt, artificial sequence
  siRNA Antisense Sequence
gauacuggagggcgucguuc

SEQ ID NO: 1870 - RNA, 20 nt, artificial sequence
  siRNA Antisense Sequence
ugauacuggagggcgucguu

SEQ ID NO: 1871 - RNA, 20 nt, artificial sequence
  siRNA Antisense Sequence
augauacuggagggcgucgu

SEQ ID NO: 1872 - RNA, 20 nt, artificial sequence
  siRNA Antisense Sequence
uaugauacuggagggcgucg

SEQ ID NO: 1873 - RNA, 20 nt, artificial sequence
  siRNA Antisense Sequence
uuguuaugauacuggagggc

SEQ ID NO: 1874 - RNA, 20 nt, artificial sequence
  siRNA Antisense Sequence
guuguuaugauacuggaggg

SEQ ID NO: 1875 - RNA, 20 nt, artificial sequence
  siRNA Antisense Sequence
uguuguuaugauacuggagg

SEQ ID NO: 1876 - RNA, 20 nt, artificial sequence
  siRNA Antisense Sequence
cuguguuguuaugauacugg

SEQ ID NO: 1877 - RNA, 20 nt, artificial sequence
  siRNA Antisense Sequence
gcuguguuguuaugauacug

SEQ ID NO: 1878 - RNA, 20 nt, artificial sequence
  siRNA Antisense Sequence
ggcuguguuguuaugauacu

SEQ ID NO: 1879 - RNA, 20 nt, artificial sequence
  siRNA Antisense Sequence
aggcuguguuguuaugauac

SEQ ID NO: 1880 - RNA, 20 nt, artificial sequence
  siRNA Antisense Sequence
gaaggcuguguuguuaugau

SEQ ID NO: 1881 - RNA, 20 nt, artificial sequence
  siRNA Antisense Sequence
ugaaggcuguguuguuauga

SEQ ID NO: 1882 - RNA, 20 nt, artificial sequence
  siRNA Antisense Sequence
cugaaggcuguguuguuaug

SEQ ID NO: 1883 - RNA, 20 nt, artificial sequence
  siRNA Antisense Sequence
gcugaaggcuguguuguuau

SEQ ID NO: 1884 - RNA, 20 nt, artificial sequence
  siRNA Antisense Sequence
ugcugaaggcuguguuguua

SEQ ID NO: 1885 - RNA, 20 nt, artificial sequence
  siRNA Antisense Sequence
uguccuuguccuuggugcug

SEQ ID NO: 1886 - RNA, 20 nt, artificial sequence
  siRNA Antisense Sequence
uuguccuuguccuuggugcu

SEQ ID NO: 1887 - RNA, 20 nt, artificial sequence
  siRNA Antisense Sequence
gcaguugucauuguccuugu

SEQ ID NO: 1888 - RNA, 20 nt, artificial sequence
  siRNA Antisense Sequence
ccaagcaguugucauugucc

SEQ ID NO: 1889 - RNA, 20 nt, artificial sequence
  siRNA Antisense Sequence
uccaagcaguugucauuguc

SEQ ID NO: 1890 - RNA, 20 nt, artificial sequence
  siRNA Antisense Sequence
uguccaagcaguugucauug

SEQ ID NO: 1891 - RNA, 20 nt, artificial sequence
  siRNA Antisense Sequence
uuguccaagcaguugucauu

SEQ ID NO: 1892 - RNA, 20 nt, artificial sequence
  siRNA Antisense Sequence
cuuguccaagcaguugucau

SEQ ID NO: 1893 - RNA, 20 nt, artificial sequence
  siRNA Antisense Sequence
acuuguccaagcaguuguca

SEQ ID NO: 1894 - RNA, 20 nt, artificial sequence
  siRNA Antisense Sequence
cacuuguccaagcaguuguc

SEQ ID NO: 1895 - RNA, 20 nt, artificial sequence
  siRNA Antisense Sequence
acacuuguccaagcaguugu

SEQ ID NO: 1896 - RNA, 20 nt, artificial sequence
  siRNA Antisense Sequence
cacacuuguccaagcaguug

SEQ ID NO: 1897 - RNA, 20 nt, artificial sequence
  siRNA Antisense Sequence
gcacacuuguccaagcaguu

SEQ ID NO: 1898 - RNA, 20 nt, artificial sequence
  siRNA Antisense Sequence
ugcacacuuguccaagcagu

SEQ ID NO: 1899 - RNA, 20 nt, artificial sequence
  siRNA Antisense Sequence
caccuuugcggagcugugca

SEQ ID NO: 1900 - RNA, 20 nt, artificial sequence
  siRNA Antisense Sequence
agccaccuuugcggagcugu

SEQ ID NO: 1901 - RNA, 20 nt, artificial sequence
  siRNA Antisense Sequence
uagccaccuuugcggagcug

SEQ ID NO: 1902 - RNA, 20 nt, artificial sequence
  siRNA Antisense Sequence
guagccaccuuugcggagcu

SEQ ID NO: 1903 - RNA, 20 nt, artificial sequence
  siRNA Antisense Sequence
aguagccaccuuugcggagc

SEQ ID NO: 1904 - RNA, 20 nt, artificial sequence
  siRNA Antisense Sequence
caguagccaccuuugcggag

SEQ ID NO: 1905 - RNA, 20 nt, artificial sequence
  siRNA Antisense Sequence
ccaguagccaccuuugcgga

SEQ ID NO: 1906 - RNA, 20 nt, artificial sequence
  siRNA Antisense Sequence
accaguagccaccuuugcgg

SEQ ID NO: 1907 - RNA, 20 nt, artificial sequence
  siRNA Antisense Sequence
uaccaguagccaccuuugcg

SEQ ID NO: 1908 - RNA, 20 nt, artificial sequence
  siRNA Antisense Sequence
guaccaguagccaccuuugc

SEQ ID NO: 1909 - RNA, 20 nt, artificial sequence
  siRNA Antisense Sequence
uguaccaguagccaccuuug

SEQ ID NO: 1910 - RNA, 20 nt, artificial sequence
  siRNA Antisense Sequence
uuguaccaguagccaccuuu

SEQ ID NO: 1911 - RNA, 20 nt, artificial sequence
  siRNA Antisense Sequence
guuguaccaguagccaccuu

SEQ ID NO: 1912 - RNA, 20 nt, artificial sequence
  siRNA Antisense Sequence
aguuguaccaguagccaccu

SEQ ID NO: 1913 - RNA, 20 nt, artificial sequence
  siRNA Antisense Sequence
cagcaguuguaccaguagcc

SEQ ID NO: 1914 - RNA, 20 nt, artificial sequence
  siRNA Antisense Sequence
gcagcaguuguaccaguagc

SEQ ID NO: 1915 - RNA, 20 nt, artificial sequence
  siRNA Antisense Sequence
gugcagcaguuguaccagua

SEQ ID NO: 1916 - RNA, 20 nt, artificial sequence
  siRNA Antisense Sequence
ugugcagcaguuguaccagu

SEQ ID NO: 1917 - RNA, 20 nt, artificial sequence
  siRNA Antisense Sequence
cugugcagcaguuguaccag

SEQ ID NO: 1918 - RNA, 20 nt, artificial sequence
  siRNA Antisense Sequence
ucugugcagcaguuguacca

SEQ ID NO: 1919 - RNA, 20 nt, artificial sequence
  siRNA Antisense Sequence
gucugugcagcaguuguacc

SEQ ID NO: 1920 - RNA, 20 nt, artificial sequence
  siRNA Antisense Sequence
agucugugcagcaguuguac

SEQ ID NO: 1921 - RNA, 20 nt, artificial sequence
  siRNA Antisense Sequence
gagucugugcagcaguugua

SEQ ID NO: 1922 - RNA, 20 nt, artificial sequence
  siRNA Antisense Sequence
ggagucugugcagcaguugu

SEQ ID NO: 1923 - RNA, 20 nt, artificial sequence
  siRNA Antisense Sequence
uuggagucugugcagcaguu

SEQ ID NO: 1924 - RNA, 20 nt, artificial sequence
  siRNA Antisense Sequence
guuggagucugugcagcagu

SEQ ID NO: 1925 - RNA, 20 nt, artificial sequence
  siRNA Antisense Sequence
gagguuggagucugugcagc

SEQ ID NO: 1926 - RNA, 20 nt, artificial sequence
  siRNA Antisense Sequence
auugagguuggagucugugc

SEQ ID NO: 1927 - RNA, 20 nt, artificial sequence
  siRNA Antisense Sequence
cauugagguuggagucugug

SEQ ID NO: 1928 - RNA, 20 nt, artificial sequence
  siRNA Antisense Sequence
ccauugagguuggagucugu

SEQ ID NO: 1929 - RNA, 20 nt, artificial sequence
  siRNA Antisense Sequence
guacacuccauugagguugg

SEQ ID NO: 1930 - RNA, 20 nt, artificial sequence
  siRNA Antisense Sequence
uaguacacuccauugagguu

SEQ ID NO: 1931 - RNA, 20 nt, artificial sequence
  siRNA Antisense Sequence
gguaguacacuccauugagg

SEQ ID NO: 1932 - RNA, 20 nt, artificial sequence
  siRNA Antisense Sequence
cgguaguacacuccauugag

SEQ ID NO: 1933 - RNA, 20 nt, artificial sequence
  siRNA Antisense Sequence
gcgguaguacacuccauuga

SEQ ID NO: 1934 - RNA, 20 nt, artificial sequence
  siRNA Antisense Sequence
ggcgguaguacacuccauug

SEQ ID NO: 1935 - RNA, 20 nt, artificial sequence
  siRNA Antisense Sequence
aggcgguaguacacuccauu

SEQ ID NO: 1936 - RNA, 20 nt, artificial sequence
  siRNA Antisense Sequence
caggcgguaguacacuccau

SEQ ID NO: 1937 - RNA, 20 nt, artificial sequence
  siRNA Antisense Sequence
ccaggcgguaguacacucca

SEQ ID NO: 1938 - RNA, 20 nt, artificial sequence
  siRNA Antisense Sequence
cucacccaggcgguaguaca

SEQ ID NO: 1939 - RNA, 20 nt, artificial sequence
  siRNA Antisense Sequence
ugcucacccaggcgguagua

SEQ ID NO: 1940 - RNA, 20 nt, artificial sequence
  siRNA Antisense Sequence
gcuuauugugcucacccagg

SEQ ID NO: 1941 - RNA, 20 nt, artificial sequence
  siRNA Antisense Sequence
ugcuuauugugcucacccag

SEQ ID NO: 1942 - RNA, 20 nt, artificial sequence
  siRNA Antisense Sequence
gugcuuauugugcucaccca

SEQ ID NO: 1943 - RNA, 20 nt, artificial sequence
  siRNA Antisense Sequence
ccaggugcuuauugugcuca

SEQ ID NO: 1944 - RNA, 20 nt, artificial sequence
  siRNA Antisense Sequence
uccaggugcuuauugugcuc

SEQ ID NO: 1945 - RNA, 20 nt, artificial sequence
  siRNA Antisense Sequence
ccauccaggugcuuauugug

SEQ ID NO: 1946 - RNA, 20 nt, artificial sequence
  siRNA Antisense Sequence
gccauccaggugcuuauugu

SEQ ID NO: 1947 - RNA, 20 nt, artificial sequence
  siRNA Antisense Sequence
ugccauccaggugcuuauug

SEQ ID NO: 1948 - RNA, 20 nt, artificial sequence
  siRNA Antisense Sequence
augccauccaggugcuuauu

SEQ ID NO: 1949 - RNA, 20 nt, artificial sequence
  siRNA Antisense Sequence
gaugccauccaggugcuuau

SEQ ID NO: 1950 - RNA, 20 nt, artificial sequence
  siRNA Antisense Sequence
ugaugccauccaggugcuua

SEQ ID NO: 1951 - RNA, 20 nt, artificial sequence
  siRNA Antisense Sequence
accaggugaugccauccagg

SEQ ID NO: 1952 - RNA, 20 nt, artificial sequence
  siRNA Antisense Sequence
uaccaggugaugccauccag

SEQ ID NO: 1953 - RNA, 20 nt, artificial sequence
  siRNA Antisense Sequence
uagguagauccaugccagcc

SEQ ID NO: 1954 - RNA, 20 nt, artificial sequence
  siRNA Antisense Sequence
guagguagauccaugccagc

SEQ ID NO: 1955 - RNA, 20 nt, artificial sequence
  siRNA Antisense Sequence
gaguagguagauccaugcca

SEQ ID NO: 1956 - RNA, 20 nt, artificial sequence
  siRNA Antisense Sequence
ggaguagguagauccaugcc

SEQ ID NO: 1957 - RNA, 20 nt, artificial sequence
  siRNA Antisense Sequence
gggaguagguagauccaugc

SEQ ID NO: 1958 - RNA, 20 nt, artificial sequence
  siRNA Antisense Sequence
agggaguagguagauccaug

SEQ ID NO: 1959 - RNA, 20 nt, artificial sequence
  siRNA Antisense Sequence
gagggaguagguagauccau

SEQ ID NO: 1960 - RNA, 20 nt, artificial sequence
  siRNA Antisense Sequence
ugagggaguagguagaucca

SEQ ID NO: 1961 - RNA, 20 nt, artificial sequence
  siRNA Antisense Sequence
uugagggaguagguagaucc

SEQ ID NO: 1962 - RNA, 20 nt, artificial sequence
  siRNA Antisense Sequence
uuugagggaguagguagauc

SEQ ID NO: 1963 - RNA, 20 nt, artificial sequence
  siRNA Antisense Sequence
cguuugagggaguagguaga

SEQ ID NO: 1964 - RNA, 20 nt, artificial sequence
  siRNA Antisense Sequence
ccguuugagggaguagguag

SEQ ID NO: 1965 - RNA, 20 nt, artificial sequence
  siRNA Antisense Sequence
cccguuugagggaguaggua

SEQ ID NO: 1966 - RNA, 20 nt, artificial sequence
  siRNA Antisense Sequence
acccguuugagggaguaggu

SEQ ID NO: 1967 - RNA, 20 nt, artificial sequence
  siRNA Antisense Sequence
cacccguuugagggaguagg

SEQ ID NO: 1968 - RNA, 20 nt, artificial sequence
  siRNA Antisense Sequence
ccacccguuugagggaguag

SEQ ID NO: 1969 - RNA, 20 nt, artificial sequence
  siRNA Antisense Sequence
uccacccguuugagggagua

SEQ ID NO: 1970 - RNA, 20 nt, artificial sequence
  siRNA Antisense Sequence
aucuccacccguuugaggga

SEQ ID NO: 1971 - RNA, 20 nt, artificial sequence
  siRNA Antisense Sequence
caucuccacccguuugaggg

SEQ ID NO: 1972 - RNA, 20 nt, artificial sequence
  siRNA Antisense Sequence
ucaucuccacccguuugagg

SEQ ID NO: 1973 - RNA, 20 nt, artificial sequence
  siRNA Antisense Sequence
uucaucuccacccguuugag

SEQ ID NO: 1974 - RNA, 20 nt, artificial sequence
  siRNA Antisense Sequence
uuucaucuccacccguuuga

SEQ ID NO: 1975 - RNA, 20 nt, artificial sequence
  siRNA Antisense Sequence
uuuucaucuccacccguuug

SEQ ID NO: 1976 - RNA, 20 nt, artificial sequence
  siRNA Antisense Sequence
auuuucaucuccacccguuu

SEQ ID NO: 1977 - RNA, 20 nt, artificial sequence
  siRNA Antisense Sequence
ggcggauuuucaucuccacc

SEQ ID NO: 1978 - RNA, 20 nt, artificial sequence
  siRNA Antisense Sequence
ggcuugaagucuucugggcg

SEQ ID NO: 1979 - RNA, 20 nt, artificial sequence
  siRNA Antisense Sequence
aaggcuugaagucuucuggg

SEQ ID NO: 1980 - RNA, 20 nt, artificial sequence
  siRNA Antisense Sequence
ccuuuuaaggcuugaagucu

SEQ ID NO: 1981 - RNA, 20 nt, artificial sequence
  siRNA Antisense Sequence
cuccuuuuaaggcuugaagu

SEQ ID NO: 1982 - RNA, 20 nt, artificial sequence
  siRNA Antisense Sequence
ccuccuuuuaaggcuugaag

SEQ ID NO: 1983 - RNA, 20 nt, artificial sequence
  siRNA Antisense Sequence
acggcagccuccuuuuaagg

SEQ ID NO: 1984 - RNA, 20 nt, artificial sequence
  siRNA Antisense Sequence
cacggcagccuccuuuuaag

SEQ ID NO: 1985 - RNA, 20 nt, artificial sequence
  siRNA Antisense Sequence
cuccacggcagccuccuuuu

SEQ ID NO: 1986 - RNA, 20 nt, artificial sequence
  siRNA Antisense Sequence
uuucuguauccgugcuccac

SEQ ID NO: 1987 - RNA, 20 nt, artificial sequence
  siRNA Antisense Sequence
aguuucuguauccgugcucc

SEQ ID NO: 1988 - RNA, 20 nt, artificial sequence
  siRNA Antisense Sequence
caguuucuguauccgugcuc

SEQ ID NO: 1989 - RNA, 20 nt, artificial sequence
  siRNA Antisense Sequence
cucaguuucuguauccgugc

SEQ ID NO: 1990 - RNA, 20 nt, artificial sequence
  siRNA Antisense Sequence
ugucucaguuucuguauccg

SEQ ID NO: 1991 - RNA, 20 nt, artificial sequence
  siRNA Antisense Sequence
ugcccucauccagucuccac

SEQ ID NO: 1992 - RNA, 20 nt, artificial sequence
  siRNA Antisense Sequence
aucugcccucauccagucuc

SEQ ID NO: 1993 - RNA, 20 nt, artificial sequence
  siRNA Antisense Sequence
caucugcccucauccagucu

SEQ ID NO: 1994 - RNA, 20 nt, artificial sequence
  siRNA Antisense Sequence
ucaucugcccucauccaguc

SEQ ID NO: 1995 - RNA, 20 nt, artificial sequence
  siRNA Antisense Sequence
ccucaucugcccucauccag

SEQ ID NO: 1996 - RNA, 20 nt, artificial sequence
  siRNA Antisense Sequence
cuaacacucucuuccugucc

SEQ ID NO: 1997 - RNA, 20 nt, artificial sequence
  siRNA Antisense Sequence
ucuaacacucucuuccuguc

SEQ ID NO: 1998 - RNA, 20 nt, artificial sequence
  siRNA Antisense Sequence
uucuaacacucucuuccugu

SEQ ID NO: 1999 - RNA, 20 nt, artificial sequence
  siRNA Antisense Sequence
uauaggcuguuucucagucc

SEQ ID NO: 2000 - RNA, 20 nt, artificial sequence
  siRNA Antisense Sequence
ccuuggagacuuauucuuuc

SEQ ID NO: 2001 - RNA, 20 nt, artificial sequence
  siRNA Antisense Sequence
gcuccuuggagacuuauucu

SEQ ID NO: 2002 - RNA, 20 nt, artificial sequence
  siRNA Antisense Sequence
ugcuccuuggagacuuauuc

SEQ ID NO: 2003 - RNA, 20 nt, artificial sequence
  siRNA Antisense Sequence
uuuugugcuccuuggagacu

SEQ ID NO: 2004 - RNA, 20 nt, artificial sequence
  siRNA Antisense Sequence
uacuguaacauccuugguac

SEQ ID NO: 2005 - RNA, 20 nt, artificial sequence
  siRNA Antisense Sequence
guuuacuguaacauccuugg

SEQ ID NO: 2006 - RNA, 20 nt, artificial sequence
  siRNA Antisense Sequence
aggauguggcaggacccagu

SEQ ID NO: 2007 - RNA, 20 nt, artificial sequence
  siRNA Antisense Sequence
aaggauguggcaggacccag

SEQ ID NO: 2008 - RNA, 20 nt, artificial sequence
  siRNA Antisense Sequence
gaaggauguggcaggaccca

SEQ ID NO: 2009 - RNA, 20 nt, artificial sequence
  siRNA Antisense Sequence
ugagaaggauguggcaggac

SEQ ID NO: 2010 - RNA, 20 nt, artificial sequence
  siRNA Antisense Sequence
cagucuaccaccuugagaag

SEQ ID NO: 2011 - RNA, 20 nt, artificial sequence
  siRNA Antisense Sequence
cacucagucuaccaccuuga

SEQ ID NO: 2012 - RNA, 20 nt, artificial sequence
  siRNA Antisense Sequence
ggaucuugggcagagagacc

SEQ ID NO: 2013 - RNA, 20 nt, artificial sequence
  siRNA Antisense Sequence
gggaucuugggcagagagac

SEQ ID NO: 2014 - RNA, 20 nt, artificial sequence
  siRNA Antisense Sequence
agggaucuugggcagagaga

SEQ ID NO: 2015 - RNA, 20 nt, artificial sequence
  siRNA Antisense Sequence
cagggaucuugggcagagag

SEQ ID NO: 2016 - RNA, 20 nt, artificial sequence
  siRNA Antisense Sequence
ugucagggaucuugggcaga

SEQ ID NO: 2017 - RNA, 20 nt, artificial sequence
  siRNA Antisense Sequence
augucagggaucuugggcag

SEQ ID NO: 2018 - RNA, 20 nt, artificial sequence
  siRNA Antisense Sequence
uaugucagggaucuugggca

SEQ ID NO: 2019 - RNA, 20 nt, artificial sequence
  siRNA Antisense Sequence
cuaugucagggaucuugggc

SEQ ID NO: 2020 - RNA, 20 nt, artificial sequence
  siRNA Antisense Sequence
gcuaugucagggaucuuggg

SEQ ID NO: 2021 - RNA, 20 nt, artificial sequence
  siRNA Antisense Sequence
ugcuaugucagggaucuugg

SEQ ID NO: 2022 - RNA, 20 nt, artificial sequence
  siRNA Antisense Sequence
cugcuaugucagggaucuug

SEQ ID NO: 2023 - RNA, 20 nt, artificial sequence
  siRNA Antisense Sequence
agcuacugcuaugucaggga

SEQ ID NO: 2024 - RNA, 20 nt, artificial sequence
  siRNA Antisense Sequence
aagcuacugcuaugucaggg

SEQ ID NO: 2025 - RNA, 20 nt, artificial sequence
  siRNA Antisense Sequence
aagacaagcuacugcuaugu

SEQ ID NO: 2026 - RNA, 20 nt, artificial sequence
  siRNA Antisense Sequence
cauguggaaaagacaagcua

SEQ ID NO: 2027 - RNA, 20 nt, artificial sequence
  siRNA Antisense Sequence
aucauguggaaaagacaagc

SEQ ID NO: 2028 - RNA, 20 nt, artificial sequence
  siRNA Antisense Sequence
gcccucacauagccuaagcc

SEQ ID NO: 2029 - RNA, 20 nt, artificial sequence
  siRNA Antisense Sequence
uugcccucacauagccuaag

SEQ ID NO: 2030 - RNA, 20 nt, artificial sequence
  siRNA Antisense Sequence
uuugcccucacauagccuaa

SEQ ID NO: 2031 - RNA, 20 nt, artificial sequence
  siRNA Antisense Sequence
uuuugcccucacauagccua

SEQ ID NO: 2032 - RNA, 20 nt, artificial sequence
  siRNA Antisense Sequence
guuuugcccucacauagccu

SEQ ID NO: 2033 - RNA, 20 nt, artificial sequence
  siRNA Antisense Sequence
uguuuugcccucacauagcc

SEQ ID NO: 2034 - RNA, 20 nt, artificial sequence
  siRNA Antisense Sequence
guguuuugcccucacauagc

SEQ ID NO: 2035 - RNA, 20 nt, artificial sequence
  siRNA Antisense Sequence
gauuuguguuuugcccucac

SEQ ID NO: 2036 - RNA, 20 nt, artificial sequence
  siRNA Antisense Sequence
ggauuuguguuuugcccuca

SEQ ID NO: 2037 - RNA, 20 nt, artificial sequence
  siRNA Antisense Sequence
aagggauuuguguuuugccc

SEQ ID NO: 2038 - RNA, 20 nt, artificial sequence
  siRNA Antisense Sequence
acuccuuucucuaacacuca

SEQ ID NO: 2039 - RNA, 20 nt, artificial sequence
  siRNA Antisense Sequence
caccugccuccuucacuccu

SEQ ID NO: 2040 - RNA, 20 nt, artificial sequence
  siRNA Antisense Sequence
uaccauuucccaccugccuc

SEQ ID NO: 2041 - RNA, 20 nt, artificial sequence
  siRNA Antisense Sequence
auaccauuucccaccugccu

SEQ ID NO: 2042 - RNA, 20 nt, artificial sequence
  siRNA Antisense Sequence
uccagccugggucaguucca

SEQ ID NO: 2043 - RNA, 20 nt, artificial sequence
  siRNA Antisense Sequence
ugcagugcccuggaguuucc

SEQ ID NO: 2044 - RNA, 20 nt, artificial sequence
  siRNA Antisense Sequence
gaugcagugcccuggaguuu

SEQ ID NO: 2045 - RNA, 20 nt, artificial sequence
  siRNA Antisense Sequence
cagaugcagugcccuggagu

SEQ ID NO: 2046 - RNA, 20 nt, artificial sequence
  siRNA Antisense Sequence
ugaucgccagaugcagugcc

SEQ ID NO: 2047 - RNA, 20 nt, artificial sequence
  siRNA Antisense Sequence
cugaucgccagaugcagugc

SEQ ID NO: 2048 - RNA, 20 nt, artificial sequence
  siRNA Antisense Sequence
acaugaccaaggcgagcagg

SEQ ID NO: 2049 - RNA, 20 nt, artificial sequence
  siRNA Antisense Sequence
uacaugaccaaggcgagcag

SEQ ID NO: 2050 - RNA, 20 nt, artificial sequence
  siRNA Antisense Sequence
gcuggugcuucauuccuuuc

SEQ ID NO: 2051 - RNA, 20 nt, artificial sequence
  siRNA Antisense Sequence
cugcuggugcuucauuccuu

SEQ ID NO: 2052 - RNA, 20 nt, artificial sequence
  siRNA Antisense Sequence
ccugcuggugcuucauuccu

SEQ ID NO: 2053 - RNA, 20 nt, artificial sequence
  siRNA Antisense Sequence
acucuguccaccuccugcug

SEQ ID NO: 2054 - RNA, 20 nt, artificial sequence
  siRNA Antisense Sequence
agagacucuguccaccuccu

SEQ ID NO: 2055 - RNA, 20 nt, artificial sequence
  siRNA Antisense Sequence
augagagacucuguccaccu

SEQ ID NO: 2056 - RNA, 20 nt, artificial sequence
  siRNA Antisense Sequence
cauccaugagagacucuguc

SEQ ID NO: 2057 - RNA, 20 nt, artificial sequence
  siRNA Antisense Sequence
gcauccaugagagacucugu

SEQ ID NO: 2058 - RNA, 20 nt, artificial sequence
  siRNA Antisense Sequence
ggcauccaugagagacucug

SEQ ID NO: 2059 - RNA, 20 nt, artificial sequence
  siRNA Antisense Sequence
ccuugagcuuguuucuuaca

SEQ ID NO: 2060 - RNA, 20 nt, artificial sequence
  siRNA Antisense Sequence
uucaaccauuuccuacagac

SEQ ID NO: 2061 - RNA, 20 nt, artificial sequence
  siRNA Antisense Sequence
ccaucuaccuucaguuuuca

SEQ ID NO: 2062 - RNA, 20 nt, artificial sequence
  siRNA Antisense Sequence
acaccaucuaccuucaguuu

SEQ ID NO: 2063 - RNA, 20 nt, artificial sequence
  siRNA Antisense Sequence
aacaccaucuaccuucaguu

SEQ ID NO: 2064 - RNA, 20 nt, artificial sequence
  siRNA Antisense Sequence
uaacaccaucuaccuucagu

SEQ ID NO: 2065 - RNA, 19 nt, artificial sequence
  siRNA sense sequence
aaaggcuagcaaagagcaa

SEQ ID NO: 2066 - RNA, 19 nt, artificial sequence
  siRNA antisense sequence
uugcucuuugcuagccuuu

SEQ ID NO: 2067 - RNA, 19 nt, artificial sequence
  siRNA sense sequence
aaggcuagcaaagagcaag

SEQ ID NO: 2068 - RNA, 19 nt, artificial sequence
  siRNA antisense sequence
cuugcucuuugcuagccuu

SEQ ID NO: 2069 - RNA, 19 nt, artificial sequence
  siRNA sense sequence
aggcuagcaaagagcaagg

SEQ ID NO: 2070 - RNA, 19 nt, artificial sequence
  siRNA antisense sequence
ccuugcucuuugcuagccu

SEQ ID NO: 2071 - RNA, 19 nt, artificial sequence
  siRNA sense sequence
ggcuagcaaagagcaagga

SEQ ID NO: 2072 - RNA, 19 nt, artificial sequence
  siRNA antisense sequence
uccuugcucuuugcuagcc

SEQ ID NO: 2073 - RNA, 19 nt, artificial sequence
  siRNA sense sequence
gcuagcaaagagcaaggaa

SEQ ID NO: 2074 - RNA, 19 nt, artificial sequence
  siRNA antisense sequence
uuccuugcucuuugcuagc

SEQ ID NO: 2075 - RNA, 19 nt, artificial sequence
  siRNA sense sequence
caaaguggcgaggcccuca

SEQ ID NO: 2076 - RNA, 19 nt, artificial sequence
  siRNA antisense sequence
ugagggccucgccacuuug

SEQ ID NO: 2077 - RNA, 19 nt, artificial sequence
  siRNA sense sequence
aaaguggcgaggcccucag

SEQ ID NO: 2078 - RNA, 19 nt, artificial sequence
  siRNA antisense sequence
cugagggccucgccacuuu

SEQ ID NO: 2079 - RNA, 19 nt, artificial sequence
  siRNA sense sequence
aaguggcgaggcccucaga

SEQ ID NO: 2080 - RNA, 19 nt, artificial sequence
  siRNA antisense sequence
ucugagggccucgccacuu

SEQ ID NO: 2081 - RNA, 19 nt, artificial sequence
  siRNA sense sequence
gcgaggcccucagagugaa

SEQ ID NO: 2082 - RNA, 19 nt, artificial sequence
  siRNA antisense sequence
uucacucugagggccucgc

SEQ ID NO: 2083 - RNA, 19 nt, artificial sequence
  siRNA sense sequence
aaagcguaagguucaguca

SEQ ID NO: 2084 - RNA, 19 nt, artificial sequence
  siRNA antisense sequence
ugacugaaccuuacgcuuu

SEQ ID NO: 2085 - RNA, 19 nt, artificial sequence
  siRNA sense sequence
aagagccuuccucacccaa

SEQ ID NO: 2086 - RNA, 19 nt, artificial sequence
  siRNA antisense sequence
uugggugaggaaggcucuu

SEQ ID NO: 2087 - RNA, 19 nt, artificial sequence
  siRNA sense sequence
agagccuuccucacccaaa

SEQ ID NO: 2088 - RNA, 19 nt, artificial sequence
  siRNA antisense sequence
uuugggugaggaaggcucu

SEQ ID NO: 2089 - RNA, 19 nt, artificial sequence
  siRNA sense sequence
aaaagccucucucagcugu

SEQ ID NO: 2090 - RNA, 19 nt, artificial sequence
  siRNA antisense sequence
acagcugagagaggcuuuu

SEQ ID NO: 2091 - RNA, 19 nt, artificial sequence
  siRNA sense sequence
aaagccucucucagcugug

SEQ ID NO: 2092 - RNA, 19 nt, artificial sequence
  siRNA antisense sequence
cacagcugagagaggcuuu

SEQ ID NO: 2093 - RNA, 19 nt, artificial sequence
  siRNA sense sequence
ucagcugugaccuggcucu

SEQ ID NO: 2094 - RNA, 19 nt, artificial sequence
  siRNA antisense sequence
agagccaggucacagcuga

SEQ ID NO: 2095 - RNA, 19 nt, artificial sequence
  siRNA sense sequence
ugaccuggcucugcauuuu

SEQ ID NO: 2096 - RNA, 19 nt, artificial sequence
  siRNA antisense sequence
aaaaugcagagccagguca

SEQ ID NO: 2097 - RNA, 19 nt, artificial sequence
  siRNA sense sequence
accuggcucugcauuuuca

SEQ ID NO: 2098 - RNA, 19 nt, artificial sequence
  siRNA antisense sequence
ugaaaaugcagagccaggu

SEQ ID NO: 2099 - RNA, 19 nt, artificial sequence
  siRNA sense sequence
ccuggcucugcauuuucau

SEQ ID NO: 2100 - RNA, 19 nt, artificial sequence
  siRNA antisense sequence
augaaaaugcagagccagg

SEQ ID NO: 2101 - RNA, 19 nt, artificial sequence
  siRNA sense sequence
gcucugcauuuucaucgug

SEQ ID NO: 2102 - RNA, 19 nt, artificial sequence
  siRNA antisense sequence
cacgaugaaaaugcagagc

SEQ ID NO: 2103 - RNA, 19 nt, artificial sequence
  siRNA sense sequence
cucugcauuuucaucgugg

SEQ ID NO: 2104 - RNA, 19 nt, artificial sequence
  siRNA antisense sequence
ccacgaugaaaaugcagag

SEQ ID NO: 2105 - RNA, 19 nt, artificial sequence
  siRNA sense sequence
ucugcauuuucaucguggc

SEQ ID NO: 2106 - RNA, 19 nt, artificial sequence
  siRNA antisense sequence
gccacgaugaaaaugcaga

SEQ ID NO: 2107 - RNA, 19 nt, artificial sequence
  siRNA sense sequence
cugcauuuucaucguggcc

SEQ ID NO: 2108 - RNA, 19 nt, artificial sequence
  siRNA antisense sequence
ggccacgaugaaaaugcag

SEQ ID NO: 2109 - RNA, 19 nt, artificial sequence
  siRNA sense sequence
ugcauuuucaucguggccu

SEQ ID NO: 2110 - RNA, 19 nt, artificial sequence
  siRNA antisense sequence
aggccacgaugaaaaugca

SEQ ID NO: 2111 - RNA, 19 nt, artificial sequence
  siRNA sense sequence
gcauuuucaucguggccuu

SEQ ID NO: 2112 - RNA, 19 nt, artificial sequence
  siRNA antisense sequence
aaggccacgaugaaaaugc

SEQ ID NO: 2113 - RNA, 19 nt, artificial sequence
  siRNA sense sequence
auuuucaucguggccuuug

SEQ ID NO: 2114 - RNA, 19 nt, artificial sequence
  siRNA antisense sequence
caaaggccacgaugaaaau

SEQ ID NO: 2115 - RNA, 19 nt, artificial sequence
  siRNA sense sequence
uuuucaucguggccuuugu

SEQ ID NO: 2116 - RNA, 19 nt, artificial sequence
  siRNA antisense sequence
acaaaggccacgaugaaaa

SEQ ID NO: 2117 - RNA, 19 nt, artificial sequence
  siRNA sense sequence
uuucaucguggccuuuguc

SEQ ID NO: 2118 - RNA, 19 nt, artificial sequence
  siRNA antisense sequence
gacaaaggccacgaugaaa

SEQ ID NO: 2119 - RNA, 19 nt, artificial sequence
  siRNA sense sequence
uucaucguggccuuuguca

SEQ ID NO: 2120 - RNA, 19 nt, artificial sequence
  siRNA antisense sequence
ugacaaaggccacgaugaa

SEQ ID NO: 2121 - RNA, 19 nt, artificial sequence
  siRNA sense sequence
ucaucguggccuuugucag

SEQ ID NO: 2122 - RNA, 19 nt, artificial sequence
  siRNA antisense sequence
cugacaaaggccacgauga

SEQ ID NO: 2123 - RNA, 19 nt, artificial sequence
  siRNA sense sequence
caucguggccuuugucagc

SEQ ID NO: 2124 - RNA, 19 nt, artificial sequence
  siRNA antisense sequence
gcugacaaaggccacgaug

SEQ ID NO: 2125 - RNA, 19 nt, artificial sequence
  siRNA sense sequence
aucguggccuuugucagcc

SEQ ID NO: 2126 - RNA, 19 nt, artificial sequence
  siRNA antisense sequence
ggcugacaaaggccacgau

SEQ ID NO: 2127 - RNA, 19 nt, artificial sequence
  siRNA sense sequence
ccuuugucagccacccagc

SEQ ID NO: 2128 - RNA, 19 nt, artificial sequence
  siRNA antisense sequence
gcuggguggcugacaaagg

SEQ ID NO: 2129 - RNA, 19 nt, artificial sequence
  siRNA sense sequence
cuuugucagccacccagcg

SEQ ID NO: 2130 - RNA, 19 nt, artificial sequence
  siRNA antisense sequence
cgcuggguggcugacaaag

SEQ ID NO: 2131 - RNA, 19 nt, artificial sequence
  siRNA sense sequence
uugucagccacccagcgug

SEQ ID NO: 2132 - RNA, 19 nt, artificial sequence
  siRNA antisense sequence
cacgcuggguggcugacaa

SEQ ID NO: 2133 - RNA, 19 nt, artificial sequence
  siRNA sense sequence
guggcugcagaagcucucu

SEQ ID NO: 2134 - RNA, 19 nt, artificial sequence
  siRNA antisense sequence
agagagcuucugcagccac

SEQ ID NO: 2135 - RNA, 19 nt, artificial sequence
  siRNA sense sequence
uggcugcagaagcucucua

SEQ ID NO: 2136 - RNA, 19 nt, artificial sequence
  siRNA antisense sequence
uagagagcuucugcagcca

SEQ ID NO: 2137 - RNA, 19 nt, artificial sequence
  siRNA sense sequence
ggcugcagaagcucucuaa

SEQ ID NO: 2138 - RNA, 19 nt, artificial sequence
  siRNA antisense sequence
uuagagagcuucugcagcc

SEQ ID NO: 2139 - RNA, 19 nt, artificial sequence
  siRNA sense sequence
gcugcagaagcucucuaag

SEQ ID NO: 2140 - RNA, 19 nt, artificial sequence
  siRNA antisense sequence
cuuagagagcuucugcagc

SEQ ID NO: 2141 - RNA, 19 nt, artificial sequence
  siRNA sense sequence
cugcagaagcucucuaagc

SEQ ID NO: 2142 - RNA, 19 nt, artificial sequence
  siRNA antisense sequence
gcuuagagagcuucugcag

SEQ ID NO: 2143 - RNA, 19 nt, artificial sequence
  siRNA sense sequence
ugcagaagcucucuaagca

SEQ ID NO: 2144 - RNA, 19 nt, artificial sequence
  siRNA antisense sequence
ugcuuagagagcuucugca

SEQ ID NO: 2145 - RNA, 19 nt, artificial sequence
  siRNA sense sequence
gcagaagcucucuaagcac

SEQ ID NO: 2146 - RNA, 19 nt, artificial sequence
  siRNA antisense sequence
gugcuuagagagcuucugc

SEQ ID NO: 2147 - RNA, 19 nt, artificial sequence
  siRNA sense sequence
ccagcacagccacagcuca

SEQ ID NO: 2148 - RNA, 19 nt, artificial sequence
  siRNA antisense sequence
ugagcuguggcugugcugg

SEQ ID NO: 2149 - RNA, 19 nt, artificial sequence
  siRNA sense sequence
cagcacagccacagcucaa

SEQ ID NO: 2150 - RNA, 19 nt, artificial sequence
  siRNA antisense sequence
uugagcuguggcugugcug

SEQ ID NO: 2151 - RNA, 19 nt, artificial sequence
  siRNA sense sequence
gcacagccacagcucaaag

SEQ ID NO: 2152 - RNA, 19 nt, artificial sequence
  siRNA antisense sequence
cuuugagcuguggcugugc

SEQ ID NO: 2153 - RNA, 19 nt, artificial sequence
  siRNA sense sequence
cacagccacagcucaaagc

SEQ ID NO: 2154 - RNA, 19 nt, artificial sequence
  siRNA antisense sequence
gcuuugagcuguggcugug

SEQ ID NO: 2155 - RNA, 19 nt, artificial sequence
  siRNA sense sequence
acagccacagcucaaagcg

SEQ ID NO: 2156 - RNA, 19 nt, artificial sequence
  siRNA antisense sequence
cgcuuugagcuguggcugu

SEQ ID NO: 2157 - RNA, 19 nt, artificial sequence
  siRNA sense sequence
cagccacagcucaaagcgg

SEQ ID NO: 2158 - RNA, 19 nt, artificial sequence
  siRNA antisense sequence
ccgcuuugagcuguggcug

SEQ ID NO: 2159 - RNA, 19 nt, artificial sequence
  siRNA sense sequence
agccacagcucaaagcggc

SEQ ID NO: 2160 - RNA, 19 nt, artificial sequence
  siRNA antisense sequence
gccgcuuugagcuguggcu

SEQ ID NO: 2161 - RNA, 19 nt, artificial sequence
  siRNA sense sequence
ggccaacugcugugaggag

SEQ ID NO: 2162 - RNA, 19 nt, artificial sequence
  siRNA antisense sequence
cuccucacagcaguuggcc

SEQ ID NO: 2163 - RNA, 19 nt, artificial sequence
  siRNA sense sequence
gccaacugcugugaggagg

SEQ ID NO: 2164 - RNA, 19 nt, artificial sequence
  siRNA antisense sequence
ccuccucacagcaguuggc

SEQ ID NO: 2165 - RNA, 19 nt, artificial sequence
  siRNA sense sequence
ccaacugcugugaggaggu

SEQ ID NO: 2166 - RNA, 19 nt, artificial sequence
  siRNA antisense sequence
accuccucacagcaguugg

SEQ ID NO: 2167 - RNA, 19 nt, artificial sequence
  siRNA sense sequence
caacugcugugaggaggug

SEQ ID NO: 2168 - RNA, 19 nt, artificial sequence
  siRNA antisense sequence
caccuccucacagcaguug

SEQ ID NO: 2169 - RNA, 19 nt, artificial sequence
  siRNA sense sequence
aacugcugugaggagguga

SEQ ID NO: 2170 - RNA, 19 nt, artificial sequence
  siRNA antisense sequence
ucaccuccucacagcaguu

SEQ ID NO: 2171 - RNA, 19 nt, artificial sequence
  siRNA sense sequence
acugcugugaggaggugaa

SEQ ID NO: 2172 - RNA, 19 nt, artificial sequence
  siRNA antisense sequence
uucaccuccucacagcagu

SEQ ID NO: 2173 - RNA, 19 nt, artificial sequence
  siRNA sense sequence
cucaaggcccaaguugcca

SEQ ID NO: 2174 - RNA, 19 nt, artificial sequence
  siRNA antisense sequence
uggcaacuugggccuugag

SEQ ID NO: 2175 - RNA, 19 nt, artificial sequence
  siRNA sense sequence
gcccaaguugccaaccuua

SEQ ID NO: 2176 - RNA, 19 nt, artificial sequence
  siRNA antisense sequence
uaagguuggcaacuugggc

SEQ ID NO: 2177 - RNA, 19 nt, artificial sequence
  siRNA sense sequence
cccaaguugccaaccuuag

SEQ ID NO: 2178 - RNA, 19 nt, artificial sequence
  siRNA antisense sequence
cuaagguuggcaacuuggg

SEQ ID NO: 2179 - RNA, 19 nt, artificial sequence
  siRNA sense sequence
ccaaguugccaaccuuagc

SEQ ID NO: 2180 - RNA, 19 nt, artificial sequence
  siRNA antisense sequence
gcuaagguuggcaacuugg

SEQ ID NO: 2181 - RNA, 19 nt, artificial sequence
  siRNA sense sequence
caaguugccaaccuuagca

SEQ ID NO: 2182 - RNA, 19 nt, artificial sequence
  siRNA antisense sequence
ugcuaagguuggcaacuug

SEQ ID NO: 2183 - RNA, 19 nt, artificial sequence
  siRNA sense sequence
aaguugccaaccuuagcag

SEQ ID NO: 2184 - RNA, 19 nt, artificial sequence
  siRNA antisense sequence
cugcuaagguuggcaacuu

SEQ ID NO: 2185 - RNA, 19 nt, artificial sequence
  siRNA sense sequence
aguugccaaccuuagcagc

SEQ ID NO: 2186 - RNA, 19 nt, artificial sequence
  siRNA antisense sequence
gcugcuaagguuggcaacu

SEQ ID NO: 2187 - RNA, 19 nt, artificial sequence
  siRNA sense sequence
gacugggucagcgugguca

SEQ ID NO: 2188 - RNA, 19 nt, artificial sequence
  siRNA antisense sequence
ugaccacgcugacccaguc

SEQ ID NO: 2189 - RNA, 19 nt, artificial sequence
  siRNA sense sequence
acugggucagcguggucau

SEQ ID NO: 2190 - RNA, 19 nt, artificial sequence
  siRNA antisense sequence
augaccacgcugacccagu

SEQ ID NO: 2191 - RNA, 19 nt, artificial sequence
  siRNA sense sequence
cugggucagcguggucaug

SEQ ID NO: 2192 - RNA, 19 nt, artificial sequence
  siRNA antisense sequence
caugaccacgcugacccag

SEQ ID NO: 2193 - RNA, 19 nt, artificial sequence
  siRNA sense sequence
ugggucagcguggucaugc

SEQ ID NO: 2194 - RNA, 19 nt, artificial sequence
  siRNA antisense sequence
gcaugaccacgcugaccca

SEQ ID NO: 2195 - RNA, 19 nt, artificial sequence
  siRNA sense sequence
gggucagcguggucaugca

SEQ ID NO: 2196 - RNA, 19 nt, artificial sequence
  siRNA antisense sequence
ugcaugaccacgcugaccc

SEQ ID NO: 2197 - RNA, 19 nt, artificial sequence
  siRNA sense sequence
cagcguggucaugcaggug

SEQ ID NO: 2198 - RNA, 19 nt, artificial sequence
  siRNA antisense sequence
caccugcaugaccacgcug

SEQ ID NO: 2199 - RNA, 19 nt, artificial sequence
  siRNA sense sequence
agcguggucaugcagguga

SEQ ID NO: 2200 - RNA, 19 nt, artificial sequence
  siRNA antisense sequence
ucaccugcaugaccacgcu

SEQ ID NO: 2201 - RNA, 19 nt, artificial sequence
  siRNA sense sequence
gcguggucaugcaggugau

SEQ ID NO: 2202 - RNA, 19 nt, artificial sequence
  siRNA antisense sequence
aucaccugcaugaccacgc

SEQ ID NO: 2203 - RNA, 19 nt, artificial sequence
  siRNA sense sequence
cguggucaugcaggugaug

SEQ ID NO: 2204 - RNA, 19 nt, artificial sequence
  siRNA antisense sequence
caucaccugcaugaccacg

SEQ ID NO: 2205 - RNA, 19 nt, artificial sequence
  siRNA sense sequence
agcaagcgcauggagucgc

SEQ ID NO: 2206 - RNA, 19 nt, artificial sequence
  siRNA antisense sequence
gcgacuccaugcgcuugcu

SEQ ID NO: 2207 - RNA, 19 nt, artificial sequence
  siRNA sense sequence
caaccaaauugacaucaug

SEQ ID NO: 2208 - RNA, 19 nt, artificial sequence
  siRNA antisense sequence
caugaugucaauuugguug

SEQ ID NO: 2209 - RNA, 19 nt, artificial sequence
  siRNA sense sequence
accaaauugacaucaugca

SEQ ID NO: 2210 - RNA, 19 nt, artificial sequence
  siRNA antisense sequence
ugcaugaugucaauuuggu

SEQ ID NO: 2211 - RNA, 19 nt, artificial sequence
  siRNA sense sequence
uugacaucaugcagcugca

SEQ ID NO: 2212 - RNA, 19 nt, artificial sequence
  siRNA antisense sequence
ugcagcugcaugaugucaa

SEQ ID NO: 2213 - RNA, 19 nt, artificial sequence
  siRNA sense sequence
caggcagcacagacgguca

SEQ ID NO: 2214 - RNA, 19 nt, artificial sequence
  siRNA antisense sequence
ugaccgucugugcugccug

SEQ ID NO: 2215 - RNA, 19 nt, artificial sequence
  siRNA sense sequence
aggcagcacagacggucac

SEQ ID NO: 2216 - RNA, 19 nt, artificial sequence
  siRNA antisense sequence
gugaccgucugugcugccu

SEQ ID NO: 2217 - RNA, 19 nt, artificial sequence
  siRNA sense sequence
ggcagcacagacggucacu

SEQ ID NO: 2218 - RNA, 19 nt, artificial sequence
  siRNA antisense sequence
agugaccgucugugcugcc

SEQ ID NO: 2219 - RNA, 19 nt, artificial sequence
  siRNA sense sequence
gcagcacagacggucacuc

SEQ ID NO: 2220 - RNA, 19 nt, artificial sequence
  siRNA antisense sequence
gagugaccgucugugcugc

SEQ ID NO: 2221 - RNA, 19 nt, artificial sequence
  siRNA sense sequence
gucacucagaccuccgcag

SEQ ID NO: 2222 - RNA, 19 nt, artificial sequence
  siRNA antisense sequence
cugcggaggucugagugac

SEQ ID NO: 2223 - RNA, 19 nt, artificial sequence
  siRNA sense sequence
ucacucagaccuccgcagg

SEQ ID NO: 2224 - RNA, 19 nt, artificial sequence
  siRNA antisense sequence
ccugcggaggucugaguga

SEQ ID NO: 2225 - RNA, 19 nt, artificial sequence
  siRNA sense sequence
cccaucuacagcacugcuu

SEQ ID NO: 2226 - RNA, 19 nt, artificial sequence
  siRNA antisense sequence
aagcagugcuguagauggg

SEQ ID NO: 2227 - RNA, 19 nt, artificial sequence
  siRNA sense sequence
ccaucuacagcacugcuuc

SEQ ID NO: 2228 - RNA, 19 nt, artificial sequence
  siRNA antisense sequence
gaagcagugcuguagaugg

SEQ ID NO: 2229 - RNA, 19 nt, artificial sequence
  siRNA sense sequence
caucuacagcacugcuucu

SEQ ID NO: 2230 - RNA, 19 nt, artificial sequence
  siRNA antisense sequence
agaagcagugcuguagaug

SEQ ID NO: 2231 - RNA, 19 nt, artificial sequence
  siRNA sense sequence
aucuacagcacugcuucua

SEQ ID NO: 2232 - RNA, 19 nt, artificial sequence
  siRNA antisense sequence
uagaagcagugcuguagau

SEQ ID NO: 2233 - RNA, 19 nt, artificial sequence
  siRNA sense sequence
ucuacagcacugcuucuac

SEQ ID NO: 2234 - RNA, 19 nt, artificial sequence
  siRNA antisense sequence
guagaagcagugcuguaga

SEQ ID NO: 2235 - RNA, 19 nt, artificial sequence
  siRNA sense sequence
cuacagcacugcuucuaca

SEQ ID NO: 2236 - RNA, 19 nt, artificial sequence
  siRNA antisense sequence
uguagaagcagugcuguag

SEQ ID NO: 2237 - RNA, 19 nt, artificial sequence
  siRNA sense sequence
acugcuucuacauauccug

SEQ ID NO: 2238 - RNA, 19 nt, artificial sequence
  siRNA antisense sequence
caggauauguagaagcagu

SEQ ID NO: 2239 - RNA, 19 nt, artificial sequence
  siRNA sense sequence
cuucuacauauccugguca

SEQ ID NO: 2240 - RNA, 19 nt, artificial sequence
  siRNA antisense sequence
ugaccaggauauguagaag

SEQ ID NO: 2241 - RNA, 19 nt, artificial sequence
  siRNA sense sequence
uucuacauauccuggucau

SEQ ID NO: 2242 - RNA, 19 nt, artificial sequence
  siRNA antisense sequence
augaccaggauauguagaa

SEQ ID NO: 2243 - RNA, 19 nt, artificial sequence
  siRNA sense sequence
cuacauauccuggucauca

SEQ ID NO: 2244 - RNA, 19 nt, artificial sequence
  siRNA antisense sequence
ugaugaccaggauauguag

SEQ ID NO: 2245 - RNA, 19 nt, artificial sequence
  siRNA sense sequence
gggccucuuuuguggguac

SEQ ID NO: 2246 - RNA, 19 nt, artificial sequence
  siRNA antisense sequence
guacccacaaaagaggccc

SEQ ID NO: 2247 - RNA, 19 nt, artificial sequence
  siRNA sense sequence
gccucuuuuguggguacac

SEQ ID NO: 2248 - RNA, 19 nt, artificial sequence
  siRNA antisense sequence
guguacccacaaaagaggc

SEQ ID NO: 2249 - RNA, 19 nt, artificial sequence
  siRNA sense sequence
ccucuuuuguggguacacu

SEQ ID NO: 2250 - RNA, 19 nt, artificial sequence
  siRNA antisense sequence
aguguacccacaaaagagg

SEQ ID NO: 2251 - RNA, 19 nt, artificial sequence
  siRNA sense sequence
cucuuuuguggguacacuu

SEQ ID NO: 2252 - RNA, 19 nt, artificial sequence
  siRNA antisense sequence
aaguguacccacaaaagag

SEQ ID NO: 2253 - RNA, 19 nt, artificial sequence
  siRNA sense sequence
guggguacacuuucccuuu

SEQ ID NO: 2254 - RNA, 19 nt, artificial sequence
  siRNA antisense sequence
aaagggaaaguguacccac

SEQ ID NO: 2255 - RNA, 19 nt, artificial sequence
  siRNA sense sequence
uggguacacuuucccuuua

SEQ ID NO: 2256 - RNA, 19 nt, artificial sequence
  siRNA antisense sequence
uaaagggaaaguguaccca

SEQ ID NO: 2257 - RNA, 19 nt, artificial sequence
  siRNA sense sequence
ggguacacuuucccuuuag

SEQ ID NO: 2258 - RNA, 19 nt, artificial sequence
  siRNA antisense sequence
cuaaagggaaaguguaccc

SEQ ID NO: 2259 - RNA, 19 nt, artificial sequence
  siRNA sense sequence
gguacacuuucccuuuagu

SEQ ID NO: 2260 - RNA, 19 nt, artificial sequence
  siRNA antisense sequence
acuaaagggaaaguguacc

SEQ ID NO: 2261 - RNA, 19 nt, artificial sequence
  siRNA sense sequence
guacacuuucccuuuagua

SEQ ID NO: 2262 - RNA, 19 nt, artificial sequence
  siRNA antisense sequence
uacuaaagggaaaguguac

SEQ ID NO: 2263 - RNA, 19 nt, artificial sequence
  siRNA sense sequence
uacacuuucccuuuaguaa

SEQ ID NO: 2264 - RNA, 19 nt, artificial sequence
  siRNA antisense sequence
uuacuaaagggaaagugua

SEQ ID NO: 2265 - RNA, 19 nt, artificial sequence
  siRNA sense sequence
acacuuucccuuuaguaaa

SEQ ID NO: 2266 - RNA, 19 nt, artificial sequence
  siRNA antisense sequence
uuuacuaaagggaaagugu

SEQ ID NO: 2267 - RNA, 19 nt, artificial sequence
  siRNA sense sequence
aggcuuaugcaguauuucc

SEQ ID NO: 2268 - RNA, 19 nt, artificial sequence
  siRNA antisense sequence
ggaaauacugcauaagccu

SEQ ID NO: 2269 - RNA, 19 nt, artificial sequence
  siRNA sense sequence
acuucuaaugcuauguaag

SEQ ID NO: 2270 - RNA, 19 nt, artificial sequence
  siRNA antisense sequence
cuuacauagcauuagaagu

SEQ ID NO: 2271 - RNA, 19 nt, artificial sequence
  siRNA sense sequence
cuucuaaugcuauguaagu

SEQ ID NO: 2272 - RNA, 19 nt, artificial sequence
  siRNA antisense sequence
acuuacauagcauuagaag

SEQ ID NO: 2273 - RNA, 19 nt, artificial sequence
  siRNA sense sequence
ugcuauguaaguuuaccua

SEQ ID NO: 2274 - RNA, 19 nt, artificial sequence
  siRNA antisense sequence
uagguaaacuuacauagca

SEQ ID NO: 2275 - RNA, 19 nt, artificial sequence
  siRNA sense sequence
gcuauguaaguuuaccuaa

SEQ ID NO: 2276 - RNA, 19 nt, artificial sequence
  siRNA antisense sequence
uuagguaaacuuacauagc

SEQ ID NO: 2277 - RNA, 19 nt, artificial sequence
  siRNA sense sequence
cuauguaaguuuaccuaac

SEQ ID NO: 2278 - RNA, 19 nt, artificial sequence
  siRNA antisense sequence
guuagguaaacuuacauag

SEQ ID NO: 2279 - RNA, 19 nt, artificial sequence
  siRNA sense sequence
acaccuucacgggucucuu

SEQ ID NO: 2280 - RNA, 19 nt, artificial sequence
  siRNA antisense sequence
aagagacccgugaaggugu

SEQ ID NO: 2281 - RNA, 19 nt, artificial sequence
  siRNA sense sequence
caccuucacgggucucuuu

SEQ ID NO: 2282 - RNA, 19 nt, artificial sequence
  siRNA antisense sequence
aaagagacccgugaaggug

SEQ ID NO: 2283 - RNA, 19 nt, artificial sequence
  siRNA sense sequence
accuucacgggucucuuuu

SEQ ID NO: 2284 - RNA, 19 nt, artificial sequence
  siRNA antisense sequence
aaaagagacccgugaaggu

SEQ ID NO: 2285 - RNA, 19 nt, artificial sequence
  siRNA sense sequence
ccuucacgggucucuuuua

SEQ ID NO: 2286 - RNA, 19 nt, artificial sequence
  siRNA antisense sequence
uaaaagagacccgugaagg

SEQ ID NO: 2287 - RNA, 19 nt, artificial sequence
  siRNA sense sequence
cuucacgggucucuuuuau

SEQ ID NO: 2288 - RNA, 19 nt, artificial sequence
  siRNA antisense sequence
auaaaagagacccgugaag

SEQ ID NO: 2289 - RNA, 19 nt, artificial sequence
  siRNA sense sequence
uucacgggucucuuuuauc

SEQ ID NO: 2290 - RNA, 19 nt, artificial sequence
  siRNA antisense sequence
gauaaaagagacccgugaa

SEQ ID NO: 2291 - RNA, 19 nt, artificial sequence
  siRNA sense sequence
ucacgggucucuuuuaucc

SEQ ID NO: 2292 - RNA, 19 nt, artificial sequence
  siRNA antisense sequence
ggauaaaagagacccguga

SEQ ID NO: 2293 - RNA, 19 nt, artificial sequence
  siRNA sense sequence
gggucucuuuuauccacac

SEQ ID NO: 2294 - RNA, 19 nt, artificial sequence
  siRNA antisense sequence
guguggauaaaagagaccc

SEQ ID NO: 2295 - RNA, 19 nt, artificial sequence
  siRNA sense sequence
cacaguguuucagccuacc

SEQ ID NO: 2296 - RNA, 19 nt, artificial sequence
  siRNA antisense sequence
gguaggcugaaacacugug

SEQ ID NO: 2297 - RNA, 19 nt, artificial sequence
  siRNA sense sequence
gauacuacaugguuugccc

SEQ ID NO: 2298 - RNA, 19 nt, artificial sequence
  siRNA antisense sequence
gggcaaaccauguaguauc

SEQ ID NO: 2299 - RNA, 19 nt, artificial sequence
  siRNA sense sequence
auacuacaugguuugccca

SEQ ID NO: 2300 - RNA, 19 nt, artificial sequence
  siRNA antisense sequence
ugggcaaaccauguaguau

SEQ ID NO: 2301 - RNA, 19 nt, artificial sequence
  siRNA sense sequence
uacuacaugguuugcccaa

SEQ ID NO: 2302 - RNA, 19 nt, artificial sequence
  siRNA antisense sequence
uugggcaaaccauguagua

SEQ ID NO: 2303 - RNA, 19 nt, artificial sequence
  siRNA sense sequence
acuacaugguuugcccaaa

SEQ ID NO: 2304 - RNA, 19 nt, artificial sequence
  siRNA antisense sequence
uuugggcaaaccauguagu

SEQ ID NO: 2305 - RNA, 19 nt, artificial sequence
  siRNA sense sequence
aagucacccagcaagucuu

SEQ ID NO: 2306 - RNA, 19 nt, artificial sequence
  siRNA antisense sequence
aagacuugcugggugacuu

SEQ ID NO: 2307 - RNA, 19 nt, artificial sequence
  siRNA sense sequence
cacccagcaagucuuagaa

SEQ ID NO: 2308 - RNA, 19 nt, artificial sequence
  siRNA antisense sequence
uucuaagacuugcugggug

SEQ ID NO: 2309 - RNA, 19 nt, artificial sequence
  siRNA sense sequence
gucuuagaagcaggguuca

SEQ ID NO: 2310 - RNA, 19 nt, artificial sequence
  siRNA antisense sequence
ugaacccugcuucuaagac

SEQ ID NO: 2311 - RNA, 19 nt, artificial sequence
  siRNA sense sequence
cuuagaagcaggguucaag

SEQ ID NO: 2312 - RNA, 19 nt, artificial sequence
  siRNA antisense sequence
cuugaacccugcuucuaag

SEQ ID NO: 2313 - RNA, 19 nt, artificial sequence
  siRNA sense sequence
uuagaagcaggguucaagu

SEQ ID NO: 2314 - RNA, 19 nt, artificial sequence
  siRNA antisense sequence
acuugaacccugcuucuaa

SEQ ID NO: 2315 - RNA, 19 nt, artificial sequence
  siRNA sense sequence
uagaagcaggguucaaguc

SEQ ID NO: 2316 - RNA, 19 nt, artificial sequence
  siRNA antisense sequence
gacuugaacccugcuucua

SEQ ID NO: 2317 - RNA, 19 nt, artificial sequence
  siRNA sense sequence
agaagcaggguucaagucu

SEQ ID NO: 2318 - RNA, 19 nt, artificial sequence
  siRNA antisense sequence
agacuugaacccugcuucu

SEQ ID NO: 2319 - RNA, 19 nt, artificial sequence
  siRNA sense sequence
gaagcaggguucaagucuu

SEQ ID NO: 2320 - RNA, 19 nt, artificial sequence
  siRNA antisense sequence
aagacuugaacccugcuuc

SEQ ID NO: 2321 - RNA, 19 nt, artificial sequence
  siRNA sense sequence
aagcaggguucaagucuuc

SEQ ID NO: 2322 - RNA, 19 nt, artificial sequence
  siRNA antisense sequence
gaagacuugaacccugcuu

SEQ ID NO: 2323 - RNA, 19 nt, artificial sequence
  siRNA sense sequence
gguucaagucuuccugauu

SEQ ID NO: 2324 - RNA, 19 nt, artificial sequence
  siRNA antisense sequence
aaucaggaagacuugaacc

SEQ ID NO: 2325 - RNA, 19 nt, artificial sequence
  siRNA sense sequence
guucaagucuuccugauug

SEQ ID NO: 2326 - RNA, 19 nt, artificial sequence
  siRNA antisense sequence
caaucaggaagacuugaac

SEQ ID NO: 2327 - RNA, 19 nt, artificial sequence
  siRNA sense sequence
uucaagucuuccugauugg

SEQ ID NO: 2328 - RNA, 19 nt, artificial sequence
  siRNA antisense sequence
ccaaucaggaagacuugaa

SEQ ID NO: 2329 - RNA, 19 nt, artificial sequence
  siRNA sense sequence
ucaagucuuccugauuggu

SEQ ID NO: 2330 - RNA, 19 nt, artificial sequence
  siRNA antisense sequence
accaaucaggaagacuuga

SEQ ID NO: 2331 - RNA, 19 nt, artificial sequence
  siRNA sense sequence
caagucuuccugauuggug

SEQ ID NO: 2332 - RNA, 19 nt, artificial sequence
  siRNA antisense sequence
caccaaucaggaagacuug

SEQ ID NO: 2333 - RNA, 19 nt, artificial sequence
  siRNA sense sequence
aagucuuccugauuggugu

SEQ ID NO: 2334 - RNA, 19 nt, artificial sequence
  siRNA antisense sequence
acaccaaucaggaagacuu

SEQ ID NO: 2335 - RNA, 19 nt, artificial sequence
  siRNA sense sequence
agucuuccugauuggugua

SEQ ID NO: 2336 - RNA, 19 nt, artificial sequence
  siRNA antisense sequence
uacaccaaucaggaagacu

SEQ ID NO: 2337 - RNA, 19 nt, artificial sequence
  siRNA sense sequence
gucuuccugauugguguag

SEQ ID NO: 2338 - RNA, 19 nt, artificial sequence
  siRNA antisense sequence
cuacaccaaucaggaagac

SEQ ID NO: 2339 - RNA, 19 nt, artificial sequence
  siRNA sense sequence
uccugauugguguagcucu

SEQ ID NO: 2340 - RNA, 19 nt, artificial sequence
  siRNA antisense sequence
agagcuacaccaaucagga

SEQ ID NO: 2341 - RNA, 19 nt, artificial sequence
  siRNA sense sequence
ccugauugguguagcucug

SEQ ID NO: 2342 - RNA, 19 nt, artificial sequence
  siRNA antisense sequence
cagagcuacaccaaucagg

SEQ ID NO: 2343 - RNA, 19 nt, artificial sequence
  siRNA sense sequence
cucugcuacuuccucacca

SEQ ID NO: 2344 - RNA, 19 nt, artificial sequence
  siRNA antisense sequence
uggugaggaaguagcagag

SEQ ID NO: 2345 - RNA, 19 nt, artificial sequence
  siRNA sense sequence
ucugcuacuuccucaccaa

SEQ ID NO: 2346 - RNA, 19 nt, artificial sequence
  siRNA antisense sequence
uuggugaggaaguagcaga

SEQ ID NO: 2347 - RNA, 19 nt, artificial sequence
  siRNA sense sequence
cugcuacuuccucaccaag

SEQ ID NO: 2348 - RNA, 19 nt, artificial sequence
  siRNA antisense sequence
cuuggugaggaaguagcag

SEQ ID NO: 2349 - RNA, 19 nt, artificial sequence
  siRNA sense sequence
ugcuacuuccucaccaaga

SEQ ID NO: 2350 - RNA, 19 nt, artificial sequence
  siRNA antisense sequence
ucuuggugaggaaguagca

SEQ ID NO: 2351 - RNA, 19 nt, artificial sequence
  siRNA sense sequence
gcuacuuccucaccaagag

SEQ ID NO: 2352 - RNA, 19 nt, artificial sequence
  siRNA antisense sequence
cucuuggugaggaaguagc

SEQ ID NO: 2353 - RNA, 19 nt, artificial sequence
  siRNA sense sequence
cuacuuccucaccaagagc

SEQ ID NO: 2354 - RNA, 19 nt, artificial sequence
  siRNA antisense sequence
gcucuuggugaggaaguag

SEQ ID NO: 2355 - RNA, 19 nt, artificial sequence
  siRNA sense sequence
acuuccucaccaagagcug

SEQ ID NO: 2356 - RNA, 19 nt, artificial sequence
  siRNA antisense sequence
cagcucuuggugaggaagu

SEQ ID NO: 2357 - RNA, 19 nt, artificial sequence
  siRNA sense sequence
cuuccucaccaagagcuga

SEQ ID NO: 2358 - RNA, 19 nt, artificial sequence
  siRNA antisense sequence
ucagcucuuggugaggaag

SEQ ID NO: 2359 - RNA, 19 nt, artificial sequence
  siRNA sense sequence
uuccucaccaagagcugac

SEQ ID NO: 2360 - RNA, 19 nt, artificial sequence
  siRNA antisense sequence
gucagcucuuggugaggaa

SEQ ID NO: 2361 - RNA, 19 nt, artificial sequence
  siRNA sense sequence
uccucaccaagagcugaca

SEQ ID NO: 2362 - RNA, 19 nt, artificial sequence
  siRNA antisense sequence
ugucagcucuuggugagga

SEQ ID NO: 2363 - RNA, 19 nt, artificial sequence
  siRNA sense sequence
ccucaccaagagcugacag

SEQ ID NO: 2364 - RNA, 19 nt, artificial sequence
  siRNA antisense sequence
cugucagcucuuggugagg

SEQ ID NO: 2365 - RNA, 19 nt, artificial sequence
  siRNA sense sequence
cucaccaagagcugacagg

SEQ ID NO: 2366 - RNA, 19 nt, artificial sequence
  siRNA antisense sequence
ccugucagcucuuggugag

SEQ ID NO: 2367 - RNA, 19 nt, artificial sequence
  siRNA sense sequence
ucaccaagagcugacaggc

SEQ ID NO: 2368 - RNA, 19 nt, artificial sequence
  siRNA antisense sequence
gccugucagcucuugguga

SEQ ID NO: 2369 - RNA, 19 nt, artificial sequence
  siRNA sense sequence
caccaagagcugacaggcu

SEQ ID NO: 2370 - RNA, 19 nt, artificial sequence
  siRNA antisense sequence
agccugucagcucuuggug

SEQ ID NO: 2371 - RNA, 19 nt, artificial sequence
  siRNA sense sequence
ccaagagcugacaggcuau

SEQ ID NO: 2372 - RNA, 19 nt, artificial sequence
  siRNA antisense sequence
auagccugucagcucuugg

SEQ ID NO: 2373 - RNA, 19 nt, artificial sequence
  siRNA sense sequence
caagagcugacaggcuaua

SEQ ID NO: 2374 - RNA, 19 nt, artificial sequence
  siRNA antisense sequence
uauagccugucagcucuug

SEQ ID NO: 2375 - RNA, 19 nt, artificial sequence
  siRNA sense sequence
aagagcugacaggcuauau

SEQ ID NO: 2376 - RNA, 19 nt, artificial sequence
  siRNA antisense sequence
auauagccugucagcucuu

SEQ ID NO: 2377 - RNA, 19 nt, artificial sequence
  siRNA sense sequence
agagcugacaggcuauauc

SEQ ID NO: 2378 - RNA, 19 nt, artificial sequence
  siRNA antisense sequence
gauauagccugucagcucu

SEQ ID NO: 2379 - RNA, 19 nt, artificial sequence
  siRNA sense sequence
gagcugacaggcuauaucu

SEQ ID NO: 2380 - RNA, 19 nt, artificial sequence
  siRNA antisense sequence
agauauagccugucagcuc

SEQ ID NO: 2381 - RNA, 19 nt, artificial sequence
  siRNA sense sequence
agcugacaggcuauaucuc

SEQ ID NO: 2382 - RNA, 19 nt, artificial sequence
  siRNA antisense sequence
gagauauagccugucagcu

SEQ ID NO: 2383 - RNA, 19 nt, artificial sequence
  siRNA sense sequence
gcugacaggcuauaucuca

SEQ ID NO: 2384 - RNA, 19 nt, artificial sequence
  siRNA antisense sequence
ugagauauagccugucagc

SEQ ID NO: 2385 - RNA, 19 nt, artificial sequence
  siRNA sense sequence
cugacaggcuauaucucaa

SEQ ID NO: 2386 - RNA, 19 nt, artificial sequence
  siRNA antisense sequence
uugagauauagccugucag

SEQ ID NO: 2387 - RNA, 19 nt, artificial sequence
  siRNA sense sequence
ugacaggcuauaucucaag

SEQ ID NO: 2388 - RNA, 19 nt, artificial sequence
  siRNA antisense sequence
cuugagauauagccuguca

SEQ ID NO: 2389 - RNA, 19 nt, artificial sequence
  siRNA sense sequence
gacaggcuauaucucaaga

SEQ ID NO: 2390 - RNA, 19 nt, artificial sequence
  siRNA antisense sequence
ucuugagauauagccuguc

SEQ ID NO: 2391 - RNA, 19 nt, artificial sequence
  siRNA sense sequence
acaggcuauaucucaagaa

SEQ ID NO: 2392 - RNA, 19 nt, artificial sequence
  siRNA antisense sequence
uucuugagauauagccugu

SEQ ID NO: 2393 - RNA, 19 nt, artificial sequence
  siRNA sense sequence
uccucuggaagcaaaguuu

SEQ ID NO: 2394 - RNA, 19 nt, artificial sequence
  siRNA antisense sequence
aaacuuugcuuccagagga

SEQ ID NO: 2395 - RNA, 19 nt, artificial sequence
  siRNA sense sequence
ccucuggaagcaaaguuuu

SEQ ID NO: 2396 - RNA, 19 nt, artificial sequence
  siRNA antisense sequence
aaaacuuugcuuccagagg

SEQ ID NO: 2397 - RNA, 19 nt, artificial sequence
  siRNA sense sequence
cucuggaagcaaaguuuug

SEQ ID NO: 2398 - RNA, 19 nt, artificial sequence
  siRNA antisense sequence
caaaacuuugcuuccagag

SEQ ID NO: 2399 - RNA, 19 nt, artificial sequence
  siRNA sense sequence
acaguucucugguguuccu

SEQ ID NO: 2400 - RNA, 19 nt, artificial sequence
  siRNA antisense sequence
aggaacaccagagaacugu

SEQ ID NO: 2401 - RNA, 19 nt, artificial sequence
  siRNA sense sequence
caguucucugguguuccua

SEQ ID NO: 2402 - RNA, 19 nt, artificial sequence
  siRNA antisense sequence
uaggaacaccagagaacug

SEQ ID NO: 2403 - RNA, 19 nt, artificial sequence
  siRNA sense sequence
aguucucugguguuccuaa

SEQ ID NO: 2404 - RNA, 19 nt, artificial sequence
  siRNA antisense sequence
uuaggaacaccagagaacu

SEQ ID NO: 2405 - RNA, 19 nt, artificial sequence
  siRNA sense sequence
guucucugguguuccuaag

SEQ ID NO: 2406 - RNA, 19 nt, artificial sequence
  siRNA antisense sequence
cuuaggaacaccagagaac

SEQ ID NO: 2407 - RNA, 19 nt, artificial sequence
  siRNA sense sequence
uucucugguguuccuaaga

SEQ ID NO: 2408 - RNA, 19 nt, artificial sequence
  siRNA antisense sequence
ucuuaggaacaccagagaa

SEQ ID NO: 2409 - RNA, 19 nt, artificial sequence
  siRNA sense sequence
cugguguuccuaagauuua

SEQ ID NO: 2410 - RNA, 19 nt, artificial sequence
  siRNA antisense sequence
uaaaucuuaggaacaccag

SEQ ID NO: 2411 - RNA, 19 nt, artificial sequence
  siRNA sense sequence
ugguguuccuaagauuuac

SEQ ID NO: 2412 - RNA, 19 nt, artificial sequence
  siRNA antisense sequence
guaaaucuuaggaacacca

SEQ ID NO: 2413 - RNA, 19 nt, artificial sequence
  siRNA sense sequence
gguguuccuaagauuuacc

SEQ ID NO: 2414 - RNA, 19 nt, artificial sequence
  siRNA antisense sequence
gguaaaucuuaggaacacc

SEQ ID NO: 2415 - RNA, 19 nt, artificial sequence
  siRNA sense sequence
guguuccuaagauuuacca

SEQ ID NO: 2416 - RNA, 19 nt, artificial sequence
  siRNA antisense sequence
ugguaaaucuuaggaacac

SEQ ID NO: 2417 - RNA, 19 nt, artificial sequence
  siRNA sense sequence
uguuccuaagauuuaccag

SEQ ID NO: 2418 - RNA, 19 nt, artificial sequence
  siRNA antisense sequence
cugguaaaucuuaggaaca

SEQ ID NO: 2419 - RNA, 19 nt, artificial sequence
  siRNA sense sequence
guuccuaagauuuaccagg

SEQ ID NO: 2420 - RNA, 19 nt, artificial sequence
  siRNA antisense sequence
ccugguaaaucuuaggaac

SEQ ID NO: 2421 - RNA, 19 nt, artificial sequence
  siRNA sense sequence
ccuaagauuuaccaggaau

SEQ ID NO: 2422 - RNA, 19 nt, artificial sequence
  siRNA antisense sequence
auuccugguaaaucuuagg

SEQ ID NO: 2423 - RNA, 19 nt, artificial sequence
  siRNA sense sequence
cuaagauuuaccaggaaug

SEQ ID NO: 2424 - RNA, 19 nt, artificial sequence
  siRNA antisense sequence
cauuccugguaaaucuuag

SEQ ID NO: 2425 - RNA, 19 nt, artificial sequence
  siRNA sense sequence
uuuaccaggaaugagcauu

SEQ ID NO: 2426 - RNA, 19 nt, artificial sequence
  siRNA antisense sequence
aaugcucauuccugguaaa

SEQ ID NO: 2427 - RNA, 19 nt, artificial sequence
  siRNA sense sequence
ccaggaaugagcauuaaug

SEQ ID NO: 2428 - RNA, 19 nt, artificial sequence
  siRNA antisense sequence
cauuaaugcucauuccugg

SEQ ID NO: 2429 - RNA, 19 nt, artificial sequence
  siRNA sense sequence
caggaaugagcauuaaugg

SEQ ID NO: 2430 - RNA, 19 nt, artificial sequence
  siRNA antisense sequence
ccauuaaugcucauuccug

SEQ ID NO: 2431 - RNA, 19 nt, artificial sequence
  siRNA sense sequence
aggaaugagcauuaaugga

SEQ ID NO: 2432 - RNA, 19 nt, artificial sequence
  siRNA antisense sequence
uccauuaaugcucauuccu

SEQ ID NO: 2433 - RNA, 19 nt, artificial sequence
  siRNA sense sequence
ggaaugagcauuaauggaa

SEQ ID NO: 2434 - RNA, 19 nt, artificial sequence
  siRNA antisense sequence
uuccauuaaugcucauucc

SEQ ID NO: 2435 - RNA, 19 nt, artificial sequence
  siRNA sense sequence
gaaugagcauuaauggaau

SEQ ID NO: 2436 - RNA, 19 nt, artificial sequence
  siRNA antisense sequence
auuccauuaaugcucauuc

SEQ ID NO: 2437 - RNA, 19 nt, artificial sequence
  siRNA sense sequence
gcauuaauggaauuuugug

SEQ ID NO: 2438 - RNA, 19 nt, artificial sequence
  siRNA antisense sequence
cacaaaauuccauuaaugc

SEQ ID NO: 2439 - RNA, 19 nt, artificial sequence
  siRNA sense sequence
uuaauggaauuuugugucc

SEQ ID NO: 2440 - RNA, 19 nt, artificial sequence
  siRNA antisense sequence
ggacacaaaauuccauuaa

SEQ ID NO: 2441 - RNA, 19 nt, artificial sequence
  siRNA sense sequence
uaauggaauuuuguguccu

SEQ ID NO: 2442 - RNA, 19 nt, artificial sequence
  siRNA antisense sequence
aggacacaaaauuccauua

SEQ ID NO: 2443 - RNA, 19 nt, artificial sequence
  siRNA sense sequence
aauggaauuuuguguccuc

SEQ ID NO: 2444 - RNA, 19 nt, artificial sequence
  siRNA antisense sequence
gaggacacaaaauuccauu

SEQ ID NO: 2445 - RNA, 19 nt, artificial sequence
  siRNA sense sequence
auggaauuuuguguccucu

SEQ ID NO: 2446 - RNA, 19 nt, artificial sequence
  siRNA antisense sequence
agaggacacaaaauuccau

SEQ ID NO: 2447 - RNA, 19 nt, artificial sequence
  siRNA sense sequence
ggaauuuuguguccucucu

SEQ ID NO: 2448 - RNA, 19 nt, artificial sequence
  siRNA antisense sequence
agagaggacacaaaauucc

SEQ ID NO: 2449 - RNA, 19 nt, artificial sequence
  siRNA sense sequence
gaauuuuguguccucucuc

SEQ ID NO: 2450 - RNA, 19 nt, artificial sequence
  siRNA antisense sequence
gagagaggacacaaaauuc

SEQ ID NO: 2451 - RNA, 19 nt, artificial sequence
  siRNA sense sequence
uuuuguguccucucucugu

SEQ ID NO: 2452 - RNA, 19 nt, artificial sequence
  siRNA antisense sequence
acagagagaggacacaaaa

SEQ ID NO: 2453 - RNA, 19 nt, artificial sequence
  siRNA sense sequence
uuuguguccucucucugua

SEQ ID NO: 2454 - RNA, 19 nt, artificial sequence
  siRNA antisense sequence
uacagagagaggacacaaa

SEQ ID NO: 2455 - RNA, 19 nt, artificial sequence
  siRNA sense sequence
uguguccucucucuguaaa

SEQ ID NO: 2456 - RNA, 19 nt, artificial sequence
  siRNA antisense sequence
uuuacagagagaggacaca

SEQ ID NO: 2457 - RNA, 19 nt, artificial sequence
  siRNA sense sequence
aacguaacucuucucauug

SEQ ID NO: 2458 - RNA, 19 nt, artificial sequence
  siRNA antisense sequence
caaugagaagaguuacguu

SEQ ID NO: 2459 - RNA, 19 nt, artificial sequence
  siRNA sense sequence
acguaacucuucucauugg

SEQ ID NO: 2460 - RNA, 19 nt, artificial sequence
  siRNA antisense sequence
ccaaugagaagaguuacgu

SEQ ID NO: 2461 - RNA, 19 nt, artificial sequence
  siRNA sense sequence
cguaacucuucucauuggc

SEQ ID NO: 2462 - RNA, 19 nt, artificial sequence
  siRNA antisense sequence
gccaaugagaagaguuacg

SEQ ID NO: 2463 - RNA, 19 nt, artificial sequence
  siRNA sense sequence
guaacucuucucauuggcu

SEQ ID NO: 2464 - RNA, 19 nt, artificial sequence
  siRNA antisense sequence
agccaaugagaagaguuac

SEQ ID NO: 2465 - RNA, 19 nt, artificial sequence
  siRNA sense sequence
uaacucuucucauuggcuc

SEQ ID NO: 2466 - RNA, 19 nt, artificial sequence
  siRNA antisense sequence
gagccaaugagaagaguua

SEQ ID NO: 2467 - RNA, 19 nt, artificial sequence
  siRNA sense sequence
aacucuucucauuggcuca

SEQ ID NO: 2468 - RNA, 19 nt, artificial sequence
  siRNA antisense sequence
ugagccaaugagaagaguu

SEQ ID NO: 2469 - RNA, 19 nt, artificial sequence
  siRNA sense sequence
acucuucucauuggcucag

SEQ ID NO: 2470 - RNA, 19 nt, artificial sequence
  siRNA antisense sequence
cugagccaaugagaagagu

SEQ ID NO: 2471 - RNA, 19 nt, artificial sequence
  siRNA sense sequence
cucuucucauuggcucaga

SEQ ID NO: 2472 - RNA, 19 nt, artificial sequence
  siRNA antisense sequence
ucugagccaaugagaagag

SEQ ID NO: 2473 - RNA, 19 nt, artificial sequence
  siRNA sense sequence
ucucauuggcucagaguua

SEQ ID NO: 2474 - RNA, 19 nt, artificial sequence
  siRNA antisense sequence
uaacucugagccaaugaga

SEQ ID NO: 2475 - RNA, 19 nt, artificial sequence
  siRNA sense sequence
auuggcucagaguuaagug

SEQ ID NO: 2476 - RNA, 19 nt, artificial sequence
  siRNA antisense sequence
cacuuaacucugagccaau

SEQ ID NO: 2477 - RNA, 19 nt, artificial sequence
  siRNA sense sequence
uuggcucagaguuaagugu

SEQ ID NO: 2478 - RNA, 19 nt, artificial sequence
  siRNA antisense sequence
acacuuaacucugagccaa

SEQ ID NO: 2479 - RNA, 19 nt, artificial sequence
  siRNA sense sequence
uggcucagaguuaagugua

SEQ ID NO: 2480 - RNA, 19 nt, artificial sequence
  siRNA antisense sequence
uacacuuaacucugagcca

SEQ ID NO: 2481 - RNA, 19 nt, artificial sequence
  siRNA sense sequence
ggcucagaguuaaguguag

SEQ ID NO: 2482 - RNA, 19 nt, artificial sequence
  siRNA antisense sequence
cuacacuuaacucugagcc

SEQ ID NO: 2483 - RNA, 19 nt, artificial sequence
  siRNA sense sequence
gcucagaguuaaguguaga

SEQ ID NO: 2484 - RNA, 19 nt, artificial sequence
  siRNA antisense sequence
ucuacacuuaacucugagc

SEQ ID NO: 2485 - RNA, 19 nt, artificial sequence
  siRNA sense sequence
cucagaguuaaguguagag

SEQ ID NO: 2486 - RNA, 19 nt, artificial sequence
  siRNA antisense sequence
cucuacacuuaacucugag

SEQ ID NO: 2487 - RNA, 19 nt, artificial sequence
  siRNA sense sequence
cauaaccaugugaagaguc

SEQ ID NO: 2488 - RNA, 19 nt, artificial sequence
  siRNA antisense sequence
gacucuucacaugguuaug

SEQ ID NO: 2489 - RNA, 19 nt, artificial sequence
  siRNA sense sequence
auaaccaugugaagagucc

SEQ ID NO: 2490 - RNA, 19 nt, artificial sequence
  siRNA antisense sequence
ggacucuucacaugguuau

SEQ ID NO: 2491 - RNA, 19 nt, artificial sequence
  siRNA sense sequence
uaaccaugugaagaguccc

SEQ ID NO: 2492 - RNA, 19 nt, artificial sequence
  siRNA antisense sequence
gggacucuucacaugguua

SEQ ID NO: 2493 - RNA, 19 nt, artificial sequence
  siRNA sense sequence
aaccaugugaagagucccu

SEQ ID NO: 2494 - RNA, 19 nt, artificial sequence
  siRNA antisense sequence
agggacucuucacaugguu

SEQ ID NO: 2495 - RNA, 19 nt, artificial sequence
  siRNA sense sequence
accaugugaagagucccuu

SEQ ID NO: 2496 - RNA, 19 nt, artificial sequence
  siRNA antisense sequence
aagggacucuucacauggu

SEQ ID NO: 2497 - RNA, 19 nt, artificial sequence
  siRNA sense sequence
ccaugugaagagucccuuu

SEQ ID NO: 2498 - RNA, 19 nt, artificial sequence
  siRNA antisense sequence
aaagggacucuucacaugg

SEQ ID NO: 2499 - RNA, 19 nt, artificial sequence
  siRNA sense sequence
caugugaagagucccuuug

SEQ ID NO: 2500 - RNA, 19 nt, artificial sequence
  siRNA antisense sequence
caaagggacucuucacaug

SEQ ID NO: 2501 - RNA, 19 nt, artificial sequence
  siRNA sense sequence
augugaagagucccuuugu

SEQ ID NO: 2502 - RNA, 19 nt, artificial sequence
  siRNA antisense sequence
acaaagggacucuucacau

SEQ ID NO: 2503 - RNA, 19 nt, artificial sequence
  siRNA sense sequence
gugaagagucccuuugugu

SEQ ID NO: 2504 - RNA, 19 nt, artificial sequence
  siRNA antisense sequence
acacaaagggacucuucac

SEQ ID NO: 2505 - RNA, 19 nt, artificial sequence
  siRNA sense sequence
ugaagagucccuuuguguu

SEQ ID NO: 2506 - RNA, 19 nt, artificial sequence
  siRNA antisense sequence
aacacaaagggacucuuca

SEQ ID NO: 2507 - RNA, 19 nt, artificial sequence
  siRNA sense sequence
aagagucccuuuguguuca

SEQ ID NO: 2508 - RNA, 19 nt, artificial sequence
  siRNA antisense sequence
ugaacacaaagggacucuu

SEQ ID NO: 2509 - RNA, 19 nt, artificial sequence
  siRNA sense sequence
agagucccuuuguguucag

SEQ ID NO: 2510 - RNA, 19 nt, artificial sequence
  siRNA antisense sequence
cugaacacaaagggacucu

SEQ ID NO: 2511 - RNA, 19 nt, artificial sequence
  siRNA sense sequence
gagucccuuuguguucagg

SEQ ID NO: 2512 - RNA, 19 nt, artificial sequence
  siRNA antisense sequence
ccugaacacaaagggacuc

SEQ ID NO: 2513 - RNA, 19 nt, artificial sequence
  siRNA sense sequence
uguucaggaaggaugcggc

SEQ ID NO: 2514 - RNA, 19 nt, artificial sequence
  siRNA antisense sequence
gccgcauccuuccugaaca

SEQ ID NO: 2515 - RNA, 19 nt, artificial sequence
  siRNA sense sequence
guucaggaaggaugcggcu

SEQ ID NO: 2516 - RNA, 19 nt, artificial sequence
  siRNA antisense sequence
agccgcauccuuccugaac

SEQ ID NO: 2517 - RNA, 19 nt, artificial sequence
  siRNA sense sequence
uucaggaaggaugcggcuc

SEQ ID NO: 2518 - RNA, 19 nt, artificial sequence
  siRNA antisense sequence
gagccgcauccuuccugaa

SEQ ID NO: 2519 - RNA, 19 nt, artificial sequence
  siRNA sense sequence
ggaugcggcuccuuaaggu

SEQ ID NO: 2520 - RNA, 19 nt, artificial sequence
  siRNA antisense sequence
accuuaaggagccgcaucc

SEQ ID NO: 2521 - RNA, 19 nt, artificial sequence
  siRNA sense sequence
gaugcggcuccuuaagguu

SEQ ID NO: 2522 - RNA, 19 nt, artificial sequence
  siRNA antisense sequence
aaccuuaaggagccgcauc

SEQ ID NO: 2523 - RNA, 19 nt, artificial sequence
  siRNA sense sequence
augcggcuccuuaagguuc

SEQ ID NO: 2524 - RNA, 19 nt, artificial sequence
  siRNA antisense sequence
gaaccuuaaggagccgcau

SEQ ID NO: 2525 - RNA, 19 nt, artificial sequence
  siRNA sense sequence
ugcggcuccuuaagguucc

SEQ ID NO: 2526 - RNA, 19 nt, artificial sequence
  siRNA antisense sequence
ggaaccuuaaggagccgca

SEQ ID NO: 2527 - RNA, 19 nt, artificial sequence
  siRNA sense sequence
gcggcuccuuaagguuccu

SEQ ID NO: 2528 - RNA, 19 nt, artificial sequence
  siRNA antisense sequence
aggaaccuuaaggagccgc

SEQ ID NO: 2529 - RNA, 19 nt, artificial sequence
  siRNA sense sequence
cggcuccuuaagguuccuc

SEQ ID NO: 2530 - RNA, 19 nt, artificial sequence
  siRNA antisense sequence
gaggaaccuuaaggagccg

SEQ ID NO: 2531 - RNA, 19 nt, artificial sequence
  siRNA sense sequence
uccuuaagguuccucaauu

SEQ ID NO: 2532 - RNA, 19 nt, artificial sequence
  siRNA antisense sequence
aauugaggaaccuuaagga

SEQ ID NO: 2533 - RNA, 19 nt, artificial sequence
  siRNA sense sequence
ccuuaagguuccucaauug

SEQ ID NO: 2534 - RNA, 19 nt, artificial sequence
  siRNA antisense sequence
caauugaggaaccuuaagg

SEQ ID NO: 2535 - RNA, 19 nt, artificial sequence
  siRNA sense sequence
cuuaagguuccucaauugu

SEQ ID NO: 2536 - RNA, 19 nt, artificial sequence
  siRNA antisense sequence
acaauugaggaaccuuaag

SEQ ID NO: 2537 - RNA, 19 nt, artificial sequence
  siRNA sense sequence
uuaagguuccucaauugug

SEQ ID NO: 2538 - RNA, 19 nt, artificial sequence
  siRNA antisense sequence
cacaauugaggaaccuuaa

SEQ ID NO: 2539 - RNA, 19 nt, artificial sequence
  siRNA sense sequence
gguuccucaauugugauac

SEQ ID NO: 2540 - RNA, 19 nt, artificial sequence
  siRNA antisense sequence
guaucacaauugaggaacc

SEQ ID NO: 2541 - RNA, 19 nt, artificial sequence
  siRNA sense sequence
guuccucaauugugauacg

SEQ ID NO: 2542 - RNA, 19 nt, artificial sequence
  siRNA antisense sequence
cguaucacaauugaggaac

SEQ ID NO: 2543 - RNA, 19 nt, artificial sequence
  siRNA sense sequence
uuccucaauugugauacgu

SEQ ID NO: 2544 - RNA, 19 nt, artificial sequence
  siRNA antisense sequence
acguaucacaauugaggaa

SEQ ID NO: 2545 - RNA, 19 nt, artificial sequence
  siRNA sense sequence
uccucaauugugauacguc

SEQ ID NO: 2546 - RNA, 19 nt, artificial sequence
  siRNA antisense sequence
gacguaucacaauugagga

SEQ ID NO: 2547 - RNA, 19 nt, artificial sequence
  siRNA sense sequence
ccucaauugugauacgucu

SEQ ID NO: 2548 - RNA, 19 nt, artificial sequence
  siRNA antisense sequence
agacguaucacaauugagg

SEQ ID NO: 2549 - RNA, 19 nt, artificial sequence
  siRNA sense sequence
cucaauugugauacgucua

SEQ ID NO: 2550 - RNA, 19 nt, artificial sequence
  siRNA antisense sequence
uagacguaucacaauugag

SEQ ID NO: 2551 - RNA, 19 nt, artificial sequence
  siRNA sense sequence
ucaauugugauacgucuau

SEQ ID NO: 2552 - RNA, 19 nt, artificial sequence
  siRNA antisense sequence
auagacguaucacaauuga

SEQ ID NO: 2553 - RNA, 19 nt, artificial sequence
  siRNA sense sequence
caauugugauacgucuauu

SEQ ID NO: 2554 - RNA, 19 nt, artificial sequence
  siRNA antisense sequence
aauagacguaucacaauug

SEQ ID NO: 2555 - RNA, 19 nt, artificial sequence
  siRNA sense sequence
uuuuccauggucuuaaaug

SEQ ID NO: 2556 - RNA, 19 nt, artificial sequence
  siRNA antisense sequence
cauuuaagaccauggaaaa

SEQ ID NO: 2557 - RNA, 19 nt, artificial sequence
  siRNA sense sequence
aaugaauuucuccgaauac

SEQ ID NO: 2558 - RNA, 19 nt, artificial sequence
  siRNA antisense sequence
guauucggagaaauucauu

SEQ ID NO: 2559 - RNA, 19 nt, artificial sequence
  siRNA sense sequence
augaauuucuccgaauaca

SEQ ID NO: 2560 - RNA, 19 nt, artificial sequence
  siRNA antisense sequence
uguauucggagaaauucau

SEQ ID NO: 2561 - RNA, 19 nt, artificial sequence
  siRNA sense sequence
ugaauuucuccgaauacag

SEQ ID NO: 2562 - RNA, 19 nt, artificial sequence
  siRNA antisense sequence
cuguauucggagaaauuca

SEQ ID NO: 2563 - RNA, 19 nt, artificial sequence
  siRNA sense sequence
uuucuccgaauacaggauu

SEQ ID NO: 2564 - RNA, 19 nt, artificial sequence
  siRNA antisense sequence
aauccuguauucggagaaa

SEQ ID NO: 2565 - RNA, 19 nt, artificial sequence
  siRNA sense sequence
uucuccgaauacaggauuu

SEQ ID NO: 2566 - RNA, 19 nt, artificial sequence
  siRNA antisense sequence
aaauccuguauucggagaa

SEQ ID NO: 2567 - RNA, 19 nt, artificial sequence
  siRNA sense sequence
ucuccgaauacaggauuuu

SEQ ID NO: 2568 - RNA, 19 nt, artificial sequence
  siRNA antisense sequence
aaaauccuguauucggaga

SEQ ID NO: 2569 - RNA, 19 nt, artificial sequence
  siRNA sense sequence
aauauagacuuaauaggcc

SEQ ID NO: 2570 - RNA, 19 nt, artificial sequence
  siRNA antisense sequence
ggccuauuaagucuauauu

SEQ ID NO: 2571 - RNA, 19 nt, artificial sequence
  siRNA sense sequence
auauagacuuaauaggcca

SEQ ID NO: 2572 - RNA, 19 nt, artificial sequence
  siRNA antisense sequence
uggccuauuaagucuauau

SEQ ID NO: 2573 - RNA, 19 nt, artificial sequence
  siRNA sense sequence
uauagacuuaauaggccaa

SEQ ID NO: 2574 - RNA, 19 nt, artificial sequence
  siRNA antisense sequence
uuggccuauuaagucuaua

SEQ ID NO: 2575 - RNA, 19 nt, artificial sequence
  siRNA sense sequence
auagacuuaauaggccaaa

SEQ ID NO: 2576 - RNA, 19 nt, artificial sequence
  siRNA antisense sequence
uuuggccuauuaagucuau

SEQ ID NO: 2577 - RNA, 19 nt, artificial sequence
  siRNA sense sequence
uagacuuaauaggccaaaa

SEQ ID NO: 2578 - RNA, 19 nt, artificial sequence
  siRNA antisense sequence
uuuuggccuauuaagucua

SEQ ID NO: 2579 - RNA, 19 nt, artificial sequence
  siRNA sense sequence
acuuuuauuucugguuagc

SEQ ID NO: 2580 - RNA, 19 nt, artificial sequence
  siRNA antisense sequence
gcuaaccagaaauaaaagu

SEQ ID NO: 2581 - RNA, 19 nt, artificial sequence
  siRNA sense sequence
cuuuuauuucugguuagcu

SEQ ID NO: 2582 - RNA, 19 nt, artificial sequence
  siRNA antisense sequence
agcuaaccagaaauaaaag

SEQ ID NO: 2583 - RNA, 19 nt, artificial sequence
  siRNA sense sequence
uuuuauuucugguuagcuc

SEQ ID NO: 2584 - RNA, 19 nt, artificial sequence
  siRNA antisense sequence
gagcuaaccagaaauaaaa

SEQ ID NO: 2585 - RNA, 19 nt, artificial sequence
  siRNA sense sequence
uuuauuucugguuagcuca

SEQ ID NO: 2586 - RNA, 19 nt, artificial sequence
  siRNA antisense sequence
ugagcuaaccagaaauaaa

SEQ ID NO: 2587 - RNA, 19 nt, artificial sequence
  siRNA sense sequence
uuauuucugguuagcucag

SEQ ID NO: 2588 - RNA, 19 nt, artificial sequence
  siRNA antisense sequence
cugagcuaaccagaaauaa

SEQ ID NO: 2589 - RNA, 19 nt, artificial sequence
  siRNA sense sequence
uucugguuagcucagcuca

SEQ ID NO: 2590 - RNA, 19 nt, artificial sequence
  siRNA antisense sequence
ugagcugagcuaaccagaa

SEQ ID NO: 2591 - RNA, 19 nt, artificial sequence
  siRNA sense sequence
ucugguuagcucagcucag

SEQ ID NO: 2592 - RNA, 19 nt, artificial sequence
  siRNA antisense sequence
cugagcugagcuaaccaga

SEQ ID NO: 2593 - RNA, 19 nt, artificial sequence
  siRNA sense sequence
cugguuagcucagcucagg

SEQ ID NO: 2594 - RNA, 19 nt, artificial sequence
  siRNA antisense sequence
ccugagcugagcuaaccag

SEQ ID NO: 2595 - RNA, 19 nt, artificial sequence
  siRNA sense sequence
ugguuagcucagcucaggu

SEQ ID NO: 2596 - RNA, 19 nt, artificial sequence
  siRNA antisense sequence
accugagcugagcuaacca

SEQ ID NO: 2597 - RNA, 19 nt, artificial sequence
  siRNA sense sequence
gguuagcucagcucaggug

SEQ ID NO: 2598 - RNA, 19 nt, artificial sequence
  siRNA antisense sequence
caccugagcugagcuaacc

SEQ ID NO: 2599 - RNA, 19 nt, artificial sequence
  siRNA sense sequence
guuagcucagcucaggugg

SEQ ID NO: 2600 - RNA, 19 nt, artificial sequence
  siRNA antisense sequence
ccaccugagcugagcuaac

SEQ ID NO: 2601 - RNA, 19 nt, artificial sequence
  siRNA sense sequence
uuagcucagcucagguggg

SEQ ID NO: 2602 - RNA, 19 nt, artificial sequence
  siRNA antisense sequence
cccaccugagcugagcuaa

SEQ ID NO: 2603 - RNA, 19 nt, artificial sequence
  siRNA sense sequence
uagcucagcucaggugggc

SEQ ID NO: 2604 - RNA, 19 nt, artificial sequence
  siRNA antisense sequence
gcccaccugagcugagcua

SEQ ID NO: 2605 - RNA, 19 nt, artificial sequence
  siRNA sense sequence
acaugaauuuacgguuuag

SEQ ID NO: 2606 - RNA, 19 nt, artificial sequence
  siRNA antisense sequence
cuaaaccguaaauucaugu

SEQ ID NO: 2607 - RNA, 19 nt, artificial sequence
  siRNA sense sequence
caugaauuuacgguuuaga

SEQ ID NO: 2608 - RNA, 19 nt, artificial sequence
  siRNA antisense sequence
ucuaaaccguaaauucaug

SEQ ID NO: 2609 - RNA, 19 nt, artificial sequence
  siRNA sense sequence
augaauuuacgguuuagag

SEQ ID NO: 2610 - RNA, 19 nt, artificial sequence
  siRNA antisense sequence
cucuaaaccguaaauucau

SEQ ID NO: 2611 - RNA, 19 nt, artificial sequence
  siRNA sense sequence
ggagcauauccuauagaca

SEQ ID NO: 2612 - RNA, 19 nt, artificial sequence
  siRNA antisense sequence
ugucuauaggauaugcucc

SEQ ID NO: 2613 - RNA, 19 nt, artificial sequence
  siRNA sense sequence
cauauccuauagacauguc

SEQ ID NO: 2614 - RNA, 19 nt, artificial sequence
  siRNA antisense sequence
gacaugucuauaggauaug

SEQ ID NO: 2615 - RNA, 19 nt, artificial sequence
  siRNA sense sequence
caaagacaugaucagcuuc

SEQ ID NO: 2616 - RNA, 19 nt, artificial sequence
  siRNA antisense sequence
gaagcugaucaugucuuug

SEQ ID NO: 2617 - RNA, 19 nt, artificial sequence
  siRNA sense sequence
aaagacaugaucagcuucu

SEQ ID NO: 2618 - RNA, 19 nt, artificial sequence
  siRNA antisense sequence
agaagcugaucaugucuuu

SEQ ID NO: 2619 - RNA, 19 nt, artificial sequence
  siRNA sense sequence
aagacaugaucagcuucua

SEQ ID NO: 2620 - RNA, 19 nt, artificial sequence
  siRNA antisense sequence
uagaagcugaucaugucuu

SEQ ID NO: 2621 - RNA, 19 nt, artificial sequence
  siRNA sense sequence
agacaugaucagcuucuac

SEQ ID NO: 2622 - RNA, 19 nt, artificial sequence
  siRNA antisense sequence
guagaagcugaucaugucu

SEQ ID NO: 2623 - RNA, 19 nt, artificial sequence
  siRNA sense sequence
cagcuucuacugacuaagu

SEQ ID NO: 2624 - RNA, 19 nt, artificial sequence
  siRNA antisense sequence
acuuagucaguagaagcug

SEQ ID NO: 2625 - RNA, 19 nt, artificial sequence
  siRNA sense sequence
agcuucuacugacuaaguc

SEQ ID NO: 2626 - RNA, 19 nt, artificial sequence
  siRNA antisense sequence
gacuuagucaguagaagcu

SEQ ID NO: 2627 - RNA, 19 nt, artificial sequence
  siRNA sense sequence
gacuaagucaaugguuaac

SEQ ID NO: 2628 - RNA, 19 nt, artificial sequence
  siRNA antisense sequence
guuaaccauugacuuaguc

SEQ ID NO: 2629 - RNA, 19 nt, artificial sequence
  siRNA sense sequence
acuaagucaaugguuaacc

SEQ ID NO: 2630 - RNA, 19 nt, artificial sequence
  siRNA antisense sequence
gguuaaccauugacuuagu

SEQ ID NO: 2631 - RNA, 19 nt, artificial sequence
  siRNA sense sequence
aaugguuaaccucagcuca

SEQ ID NO: 2632 - RNA, 19 nt, artificial sequence
  siRNA antisense sequence
ugagcugagguuaaccauu

SEQ ID NO: 2633 - RNA, 19 nt, artificial sequence
  siRNA sense sequence
guaucaaucacuuucuaag

SEQ ID NO: 2634 - RNA, 19 nt, artificial sequence
  siRNA antisense sequence
cuuagaaagugauugauac

SEQ ID NO: 2635 - RNA, 19 nt, artificial sequence
  siRNA sense sequence
uaucaaucacuuucuaagc

SEQ ID NO: 2636 - RNA, 19 nt, artificial sequence
  siRNA antisense sequence
gcuuagaaagugauugaua

SEQ ID NO: 2637 - RNA, 19 nt, artificial sequence
  siRNA sense sequence
aucaaucacuuucuaagca

SEQ ID NO: 2638 - RNA, 19 nt, artificial sequence
  siRNA antisense sequence
ugcuuagaaagugauugau

SEQ ID NO: 2639 - RNA, 19 nt, artificial sequence
  siRNA sense sequence
ucaaucacuuucuaagcau

SEQ ID NO: 2640 - RNA, 19 nt, artificial sequence
  siRNA antisense sequence
augcuuagaaagugauuga

SEQ ID NO: 2641 - RNA, 19 nt, artificial sequence
  siRNA sense sequence
caaucacuuucuaagcaug

SEQ ID NO: 2642 - RNA, 19 nt, artificial sequence
  siRNA antisense sequence
caugcuuagaaagugauug

SEQ ID NO: 2643 - RNA, 19 nt, artificial sequence
  siRNA sense sequence
aaucacuuucuaagcaugg

SEQ ID NO: 2644 - RNA, 19 nt, artificial sequence
  siRNA antisense sequence
ccaugcuuagaaagugauu

SEQ ID NO: 2645 - RNA, 19 nt, artificial sequence
  siRNA sense sequence
aucacuuucuaagcaugga

SEQ ID NO: 2646 - RNA, 19 nt, artificial sequence
  siRNA antisense sequence
uccaugcuuagaaagugau

SEQ ID NO: 2647 - RNA, 19 nt, artificial sequence
  siRNA sense sequence
ucacuuucuaagcauggac

SEQ ID NO: 2648 - RNA, 19 nt, artificial sequence
  siRNA antisense sequence
guccaugcuuagaaaguga

SEQ ID NO: 2649 - RNA, 19 nt, artificial sequence
  siRNA sense sequence
cacuuucuaagcauggacu

SEQ ID NO: 2650 - RNA, 19 nt, artificial sequence
  siRNA antisense sequence
aguccaugcuuagaaagug

SEQ ID NO: 2651 - RNA, 19 nt, artificial sequence
  siRNA sense sequence
acuuucuaagcauggacuu

SEQ ID NO: 2652 - RNA, 19 nt, artificial sequence
  siRNA antisense sequence
aaguccaugcuuagaaagu

SEQ ID NO: 2653 - RNA, 19 nt, artificial sequence
  siRNA sense sequence
cuuucuaagcauggacuuc

SEQ ID NO: 2654 - RNA, 19 nt, artificial sequence
  siRNA antisense sequence
gaaguccaugcuuagaaag

SEQ ID NO: 2655 - RNA, 19 nt, artificial sequence
  siRNA sense sequence
uuucuaagcauggacuucc

SEQ ID NO: 2656 - RNA, 19 nt, artificial sequence
  siRNA antisense sequence
ggaaguccaugcuuagaaa

SEQ ID NO: 2657 - RNA, 19 nt, artificial sequence
  siRNA sense sequence
uucuaagcauggacuuccg

SEQ ID NO: 2658 - RNA, 19 nt, artificial sequence
  siRNA antisense sequence
cggaaguccaugcuuagaa

SEQ ID NO: 2659 - RNA, 19 nt, artificial sequence
  siRNA sense sequence
ucuaagcauggacuuccgg

SEQ ID NO: 2660 - RNA, 19 nt, artificial sequence
  siRNA antisense sequence
ccggaaguccaugcuuaga

SEQ ID NO: 2661 - RNA, 19 nt, artificial sequence
  siRNA sense sequence
cuaagcauggacuuccggg

SEQ ID NO: 2662 - RNA, 19 nt, artificial sequence
  siRNA antisense sequence
cccggaaguccaugcuuag

SEQ ID NO: 2663 - RNA, 19 nt, artificial sequence
  siRNA sense sequence
ccucaguuugggauuagaa

SEQ ID NO: 2664 - RNA, 19 nt, artificial sequence
  siRNA antisense sequence
uucuaaucccaaacugagg

SEQ ID NO: 2665 - RNA, 19 nt, artificial sequence
  siRNA sense sequence
aaagguauucucaggccau

SEQ ID NO: 2666 - RNA, 19 nt, artificial sequence
  siRNA antisense sequence
auggccugagaauaccuuu

SEQ ID NO: 2667 - RNA, 19 nt, artificial sequence
  siRNA sense sequence
aagguauucucaggccauu

SEQ ID NO: 2668 - RNA, 19 nt, artificial sequence
  siRNA antisense sequence
aauggccugagaauaccuu

SEQ ID NO: 2669 - RNA, 19 nt, artificial sequence
  siRNA sense sequence
agguauucucaggccauuu

SEQ ID NO: 2670 - RNA, 19 nt, artificial sequence
  siRNA antisense sequence
aaauggccugagaauaccu

SEQ ID NO: 2671 - RNA, 19 nt, artificial sequence
  siRNA sense sequence
gguauucucaggccauuuu

SEQ ID NO: 2672 - RNA, 19 nt, artificial sequence
  siRNA antisense sequence
aaaauggccugagaauacc

SEQ ID NO: 2673 - RNA, 19 nt, artificial sequence
  siRNA sense sequence
uauucucaggccauuuucc

SEQ ID NO: 2674 - RNA, 19 nt, artificial sequence
  siRNA antisense sequence
ggaaaauggccugagaaua

SEQ ID NO: 2675 - RNA, 19 nt, artificial sequence
  siRNA sense sequence
auucucaggccauuuucca

SEQ ID NO: 2676 - RNA, 19 nt, artificial sequence
  siRNA antisense sequence
uggaaaauggccugagaau

SEQ ID NO: 2677 - RNA, 19 nt, artificial sequence
  siRNA sense sequence
uucucaggccauuuuccag

SEQ ID NO: 2678 - RNA, 19 nt, artificial sequence
  siRNA antisense sequence
cuggaaaauggccugagaa

SEQ ID NO: 2679 - RNA, 19 nt, artificial sequence
  siRNA sense sequence
ucucaggccauuuuccaga

SEQ ID NO: 2680 - RNA, 19 nt, artificial sequence
  siRNA antisense sequence
ucuggaaaauggccugaga

SEQ ID NO: 2681 - RNA, 19 nt, artificial sequence
  siRNA sense sequence
aagugaguccugauuuggu

SEQ ID NO: 2682 - RNA, 19 nt, artificial sequence
  siRNA antisense sequence
accaaaucaggacucacuu

SEQ ID NO: 2683 - RNA, 19 nt, artificial sequence
  siRNA sense sequence
agugaguccugauuugguc

SEQ ID NO: 2684 - RNA, 19 nt, artificial sequence
  siRNA antisense sequence
gaccaaaucaggacucacu

SEQ ID NO: 2685 - RNA, 19 nt, artificial sequence
  siRNA sense sequence
gugaguccugauuuggucu

SEQ ID NO: 2686 - RNA, 19 nt, artificial sequence
  siRNA antisense sequence
agaccaaaucaggacucac

SEQ ID NO: 2687 - RNA, 19 nt, artificial sequence
  siRNA sense sequence
gaguccugauuuggucugu

SEQ ID NO: 2688 - RNA, 19 nt, artificial sequence
  siRNA antisense sequence
acagaccaaaucaggacuc

SEQ ID NO: 2689 - RNA, 19 nt, artificial sequence
  siRNA sense sequence
aguccugauuuggucugug

SEQ ID NO: 2690 - RNA, 19 nt, artificial sequence
  siRNA antisense sequence
cacagaccaaaucaggacu

SEQ ID NO: 2691 - RNA, 19 nt, artificial sequence
  siRNA sense sequence
aaccagacaugcggaagac

SEQ ID NO: 2692 - RNA, 19 nt, artificial sequence
  siRNA antisense sequence
gucuuccgcaugucugguu

SEQ ID NO: 2693 - RNA, 19 nt, artificial sequence
  siRNA sense sequence
accagacaugcggaagacc

SEQ ID NO: 2694 - RNA, 19 nt, artificial sequence
  siRNA antisense sequence
ggucuuccgcaugucuggu

SEQ ID NO: 2695 - RNA, 19 nt, artificial sequence
  siRNA sense sequence
ccagacaugcggaagacca

SEQ ID NO: 2696 - RNA, 19 nt, artificial sequence
  siRNA antisense sequence
uggucuuccgcaugucugg

SEQ ID NO: 2697 - RNA, 19 nt, artificial sequence
  siRNA sense sequence
acaugcggaagaccaggcc

SEQ ID NO: 2698 - RNA, 19 nt, artificial sequence
  siRNA antisense sequence
ggccuggucuuccgcaugu

SEQ ID NO: 2699 - RNA, 19 nt, artificial sequence
  siRNA sense sequence
caugcggaagaccaggcca

SEQ ID NO: 2700 - RNA, 19 nt, artificial sequence
  siRNA antisense sequence
uggccuggucuuccgcaug

SEQ ID NO: 2701 - RNA, 19 nt, artificial sequence
  siRNA sense sequence
augcggaagaccaggccag

SEQ ID NO: 2702 - RNA, 19 nt, artificial sequence
  siRNA antisense sequence
cuggccuggucuuccgcau

SEQ ID NO: 2703 - RNA, 19 nt, artificial sequence
  siRNA sense sequence
ugcggaagaccaggccaga

SEQ ID NO: 2704 - RNA, 19 nt, artificial sequence
  siRNA antisense sequence
ucuggccuggucuuccgca

SEQ ID NO: 2705 - RNA, 19 nt, artificial sequence
  siRNA sense sequence
cggaagaccaggccagaca

SEQ ID NO: 2706 - RNA, 19 nt, artificial sequence
  siRNA antisense sequence
ugucuggccuggucuuccg

SEQ ID NO: 2707 - RNA, 19 nt, artificial sequence
  siRNA sense sequence
ggaagaccaggccagacag

SEQ ID NO: 2708 - RNA, 19 nt, artificial sequence
  siRNA antisense sequence
cugucuggccuggucuucc

SEQ ID NO: 2709 - RNA, 19 nt, artificial sequence
  siRNA sense sequence
gaagaccaggccagacaga

SEQ ID NO: 2710 - RNA, 19 nt, artificial sequence
  siRNA antisense sequence
ucugucuggccuggucuuc

SEQ ID NO: 2711 - RNA, 19 nt, artificial sequence
  siRNA sense sequence
aagaccaggccagacagag

SEQ ID NO: 2712 - RNA, 19 nt, artificial sequence
  siRNA antisense sequence
cucugucuggccuggucuu

SEQ ID NO: 2713 - RNA, 19 nt, artificial sequence
  siRNA sense sequence
agaccaggccagacagagg

SEQ ID NO: 2714 - RNA, 19 nt, artificial sequence
  siRNA antisense sequence
ccucugucuggccuggucu

SEQ ID NO: 2715 - RNA, 19 nt, artificial sequence
  siRNA sense sequence
gaccaggccagacagagga

SEQ ID NO: 2716 - RNA, 19 nt, artificial sequence
  siRNA antisense sequence
uccucugucuggccugguc

SEQ ID NO: 2717 - RNA, 19 nt, artificial sequence
  siRNA sense sequence
aggccagacagaggaaucu

SEQ ID NO: 2718 - RNA, 19 nt, artificial sequence
  siRNA antisense sequence
agauuccucugucuggccu

SEQ ID NO: 2719 - RNA, 19 nt, artificial sequence
  siRNA sense sequence
agaggaaucugaccgugcc

SEQ ID NO: 2720 - RNA, 19 nt, artificial sequence
  siRNA antisense sequence
ggcacggucagauuccucu

SEQ ID NO: 2721 - RNA, 19 nt, artificial sequence
  siRNA sense sequence
gaggaaucugaccgugcca

SEQ ID NO: 2722 - RNA, 19 nt, artificial sequence
  siRNA antisense sequence
uggcacggucagauuccuc

SEQ ID NO: 2723 - RNA, 19 nt, artificial sequence
  siRNA sense sequence
aggaaucugaccgugccac

SEQ ID NO: 2724 - RNA, 19 nt, artificial sequence
  siRNA antisense sequence
guggcacggucagauuccu

SEQ ID NO: 2725 - RNA, 19 nt, artificial sequence
  siRNA sense sequence
ggaaucugaccgugccacu

SEQ ID NO: 2726 - RNA, 19 nt, artificial sequence
  siRNA antisense sequence
aguggcacggucagauucc

SEQ ID NO: 2727 - RNA, 19 nt, artificial sequence
  siRNA sense sequence
gaaucugaccgugccacuu

SEQ ID NO: 2728 - RNA, 19 nt, artificial sequence
  siRNA antisense sequence
aaguggcacggucagauuc

SEQ ID NO: 2729 - RNA, 19 nt, artificial sequence
  siRNA sense sequence
aaucugaccgugccacuuc

SEQ ID NO: 2730 - RNA, 19 nt, artificial sequence
  siRNA antisense sequence
gaaguggcacggucagauu

SEQ ID NO: 2731 - RNA, 19 nt, artificial sequence
  siRNA sense sequence
aucugaccgugccacuucc

SEQ ID NO: 2732 - RNA, 19 nt, artificial sequence
  siRNA antisense sequence
ggaaguggcacggucagau

SEQ ID NO: 2733 - RNA, 19 nt, artificial sequence
  siRNA sense sequence
ucugaccgugccacuuccu

SEQ ID NO: 2734 - RNA, 19 nt, artificial sequence
  siRNA antisense sequence
aggaaguggcacggucaga

SEQ ID NO: 2735 - RNA, 19 nt, artificial sequence
  siRNA sense sequence
accgugccacuuccugcuc

SEQ ID NO: 2736 - RNA, 19 nt, artificial sequence
  siRNA antisense sequence
gagcaggaaguggcacggu

SEQ ID NO: 2737 - RNA, 19 nt, artificial sequence
  siRNA sense sequence
cgugccacuuccugcucau

SEQ ID NO: 2738 - RNA, 19 nt, artificial sequence
  siRNA antisense sequence
augagcaggaaguggcacg

SEQ ID NO: 2739 - RNA, 19 nt, artificial sequence
  siRNA sense sequence
gccacuuccugcucaucca

SEQ ID NO: 2740 - RNA, 19 nt, artificial sequence
  siRNA antisense sequence
uggaugagcaggaaguggc

SEQ ID NO: 2741 - RNA, 19 nt, artificial sequence
  siRNA sense sequence
ccacuuccugcucauccaa

SEQ ID NO: 2742 - RNA, 19 nt, artificial sequence
  siRNA antisense sequence
uuggaugagcaggaagugg

SEQ ID NO: 2743 - RNA, 19 nt, artificial sequence
  siRNA sense sequence
cacuuccugcucauccaaa

SEQ ID NO: 2744 - RNA, 19 nt, artificial sequence
  siRNA antisense sequence
uuuggaugagcaggaagug

SEQ ID NO: 2745 - RNA, 19 nt, artificial sequence
  siRNA sense sequence
acaggaggcuuucucacca

SEQ ID NO: 2746 - RNA, 19 nt, artificial sequence
  siRNA antisense sequence
uggugagaaagccuccugu

SEQ ID NO: 2747 - RNA, 19 nt, artificial sequence
  siRNA sense sequence
ggaggcuuucucaccaucc

SEQ ID NO: 2748 - RNA, 19 nt, artificial sequence
  siRNA antisense sequence
ggauggugagaaagccucc

SEQ ID NO: 2749 - RNA, 19 nt, artificial sequence
  siRNA sense sequence
gaggcuuucucaccauccu

SEQ ID NO: 2750 - RNA, 19 nt, artificial sequence
  siRNA antisense sequence
aggauggugagaaagccuc

SEQ ID NO: 2751 - RNA, 19 nt, artificial sequence
  siRNA sense sequence
aggcuuucucaccauccug

SEQ ID NO: 2752 - RNA, 19 nt, artificial sequence
  siRNA antisense sequence
caggauggugagaaagccu

SEQ ID NO: 2753 - RNA, 19 nt, artificial sequence
  siRNA sense sequence
ggcuuucucaccauccugc

SEQ ID NO: 2754 - RNA, 19 nt, artificial sequence
  siRNA antisense sequence
gcaggauggugagaaagcc

SEQ ID NO: 2755 - RNA, 19 nt, artificial sequence
  siRNA sense sequence
gcuuucucaccauccugca

SEQ ID NO: 2756 - RNA, 19 nt, artificial sequence
  siRNA antisense sequence
ugcaggauggugagaaagc

SEQ ID NO: 2757 - RNA, 19 nt, artificial sequence
  siRNA sense sequence
cuuucucaccauccugcaa

SEQ ID NO: 2758 - RNA, 19 nt, artificial sequence
  siRNA antisense sequence
uugcaggauggugagaaag

SEQ ID NO: 2759 - RNA, 19 nt, artificial sequence
  siRNA sense sequence
uuucucaccauccugcaag

SEQ ID NO: 2760 - RNA, 19 nt, artificial sequence
  siRNA antisense sequence
cuugcaggauggugagaaa

SEQ ID NO: 2761 - RNA, 19 nt, artificial sequence
  siRNA sense sequence
uucucaccauccugcaagg

SEQ ID NO: 2762 - RNA, 19 nt, artificial sequence
  siRNA antisense sequence
ccuugcaggauggugagaa

SEQ ID NO: 2763 - RNA, 19 nt, artificial sequence
  siRNA sense sequence
ugcagcucucccaccaggu

SEQ ID NO: 2764 - RNA, 19 nt, artificial sequence
  siRNA antisense sequence
accuggugggagagcugca

SEQ ID NO: 2765 - RNA, 19 nt, artificial sequence
  siRNA sense sequence
agcucucccaccaggucuc

SEQ ID NO: 2766 - RNA, 19 nt, artificial sequence
  siRNA antisense sequence
gagaccuggugggagagcu

SEQ ID NO: 2767 - RNA, 19 nt, artificial sequence
  siRNA sense sequence
ucuugcccaggacaucauu

SEQ ID NO: 2768 - RNA, 19 nt, artificial sequence
  siRNA antisense sequence
aaugauguccugggcaaga

SEQ ID NO: 2769 - RNA, 19 nt, artificial sequence
  siRNA sense sequence
cuugcccaggacaucauuc

SEQ ID NO: 2770 - RNA, 19 nt, artificial sequence
  siRNA antisense sequence
gaaugauguccugggcaag

SEQ ID NO: 2771 - RNA, 19 nt, artificial sequence
  siRNA sense sequence
ggacaucauuccuuauuuu

SEQ ID NO: 2772 - RNA, 19 nt, artificial sequence
  siRNA antisense sequence
aaaauaaggaaugaugucc

SEQ ID NO: 2773 - RNA, 19 nt, artificial sequence
  siRNA sense sequence
ucaguuacccuuauauucu

SEQ ID NO: 2774 - RNA, 19 nt, artificial sequence
  siRNA antisense sequence
agaauauaaggguaacuga

SEQ ID NO: 2775 - RNA, 19 nt, artificial sequence
  siRNA sense sequence
caguuacccuuauauucua

SEQ ID NO: 2776 - RNA, 19 nt, artificial sequence
  siRNA antisense sequence
uagaauauaaggguaacug

SEQ ID NO: 2777 - RNA, 19 nt, artificial sequence
  siRNA sense sequence
auucuauaaguagguaguc

SEQ ID NO: 2778 - RNA, 19 nt, artificial sequence
  siRNA antisense sequence
gacuaccuacuuauagaau

SEQ ID NO: 2779 - RNA, 19 nt, artificial sequence
  siRNA sense sequence
uucuauaaguagguagucc

SEQ ID NO: 2780 - RNA, 19 nt, artificial sequence
  siRNA antisense sequence
ggacuaccuacuuauagaa

SEQ ID NO: 2781 - RNA, 19 nt, artificial sequence
  siRNA sense sequence
ucuauaaguagguaguccc

SEQ ID NO: 2782 - RNA, 19 nt, artificial sequence
  siRNA antisense sequence
gggacuaccuacuuauaga

SEQ ID NO: 2783 - RNA, 19 nt, artificial sequence
  siRNA sense sequence
cuauaaguagguagucccu

SEQ ID NO: 2784 - RNA, 19 nt, artificial sequence
  siRNA antisense sequence
agggacuaccuacuuauag

SEQ ID NO: 2785 - RNA, 19 nt, artificial sequence
  siRNA sense sequence
uauaaguagguagucccuu

SEQ ID NO: 2786 - RNA, 19 nt, artificial sequence
  siRNA antisense sequence
aagggacuaccuacuuaua

SEQ ID NO: 2787 - RNA, 19 nt, artificial sequence
  siRNA sense sequence
gcaguaaguuggugcuuuc

SEQ ID NO: 2788 - RNA, 19 nt, artificial sequence
  siRNA antisense sequence
gaaagcaccaacuuacugc

SEQ ID NO: 2789 - RNA, 19 nt, artificial sequence
  siRNA sense sequence
cuuucaccacuaagacgaa

SEQ ID NO: 2790 - RNA, 19 nt, artificial sequence
  siRNA antisense sequence
uucgucuuaguggugaaag

SEQ ID NO: 2791 - RNA, 19 nt, artificial sequence
  siRNA sense sequence
acacguacucuaccucccu

SEQ ID NO: 2792 - RNA, 19 nt, artificial sequence
  siRNA antisense sequence
agggagguagaguacgugu

SEQ ID NO: 2793 - RNA, 19 nt, artificial sequence
  siRNA sense sequence
cacguacucuaccucccuu

SEQ ID NO: 2794 - RNA, 19 nt, artificial sequence
  siRNA antisense sequence
aagggagguagaguacgug

SEQ ID NO: 2795 - RNA, 19 nt, artificial sequence
  siRNA sense sequence
acguacucuaccucccuuu

SEQ ID NO: 2796 - RNA, 19 nt, artificial sequence
  siRNA antisense sequence
aaagggagguagaguacgu

SEQ ID NO: 2797 - RNA, 19 nt, artificial sequence
  siRNA sense sequence
cccaaggugcucugcaaga

SEQ ID NO: 2798 - RNA, 19 nt, artificial sequence
  siRNA antisense sequence
ucuugcagagcaccuuggg

SEQ ID NO: 2799 - RNA, 19 nt, artificial sequence
  siRNA sense sequence
aaccuaugugccucagaca

SEQ ID NO: 2800 - RNA, 19 nt, artificial sequence
  siRNA antisense sequence
ugucugaggcacauagguu

SEQ ID NO: 2801 - RNA, 19 nt, artificial sequence
  siRNA sense sequence
ucccaucugccaucuuggu

SEQ ID NO: 2802 - RNA, 19 nt, artificial sequence
  siRNA antisense sequence
accaagauggcagauggga

SEQ ID NO: 2803 - RNA, 19 nt, artificial sequence
  siRNA sense sequence
cccaucugccaucuuggug

SEQ ID NO: 2804 - RNA, 19 nt, artificial sequence
  siRNA antisense sequence
caccaagauggcagauggg

SEQ ID NO: 2805 - RNA, 19 nt, artificial sequence
  siRNA sense sequence
ccaucuuggugcuccucuc

SEQ ID NO: 2806 - RNA, 19 nt, artificial sequence
  siRNA antisense sequence
gagaggagcaccaagaugg

SEQ ID NO: 2807 - RNA, 19 nt, artificial sequence
  siRNA sense sequence
aucuuggugcuccucucua

SEQ ID NO: 2808 - RNA, 19 nt, artificial sequence
  siRNA antisense sequence
uagagaggagcaccaagau

SEQ ID NO: 2809 - RNA, 19 nt, artificial sequence
  siRNA sense sequence
ucuuggugcuccucucuaa

SEQ ID NO: 2810 - RNA, 19 nt, artificial sequence
  siRNA antisense sequence
uuagagaggagcaccaaga

SEQ ID NO: 2811 - RNA, 19 nt, artificial sequence
  siRNA sense sequence
cuuggugcuccucucuaag

SEQ ID NO: 2812 - RNA, 19 nt, artificial sequence
  siRNA antisense sequence
cuuagagaggagcaccaag

SEQ ID NO: 2813 - RNA, 19 nt, artificial sequence
  siRNA sense sequence
uuggugcuccucucuaagg

SEQ ID NO: 2814 - RNA, 19 nt, artificial sequence
  siRNA antisense sequence
ccuuagagaggagcaccaa

SEQ ID NO: 2815 - RNA, 19 nt, artificial sequence
  siRNA sense sequence
uggugcuccucucuaaggu

SEQ ID NO: 2816 - RNA, 19 nt, artificial sequence
  siRNA antisense sequence
accuuagagaggagcacca

SEQ ID NO: 2817 - RNA, 19 nt, artificial sequence
  siRNA sense sequence
ggugcuccucucuaagguc

SEQ ID NO: 2818 - RNA, 19 nt, artificial sequence
  siRNA antisense sequence
gaccuuagagaggagcacc

SEQ ID NO: 2819 - RNA, 19 nt, artificial sequence
  siRNA sense sequence
ugcuccucucuaagguccc

SEQ ID NO: 2820 - RNA, 19 nt, artificial sequence
  siRNA antisense sequence
gggaccuuagagaggagca

SEQ ID NO: 2821 - RNA, 19 nt, artificial sequence
  siRNA sense sequence
gcuccucucuaagguccca

SEQ ID NO: 2822 - RNA, 19 nt, artificial sequence
  siRNA antisense sequence
ugggaccuuagagaggagc

SEQ ID NO: 2823 - RNA, 19 nt, artificial sequence
  siRNA sense sequence
cucucuaaggucccagugc

SEQ ID NO: 2824 - RNA, 19 nt, artificial sequence
  siRNA antisense sequence
gcacugggaccuuagagag

SEQ ID NO: 2825 - RNA, 19 nt, artificial sequence
  siRNA sense sequence
ucucuaaggucccagugca

SEQ ID NO: 2826 - RNA, 19 nt, artificial sequence
  siRNA antisense sequence
ugcacugggaccuuagaga

SEQ ID NO: 2827 - RNA, 19 nt, artificial sequence
  siRNA sense sequence
ggucccagugcagugguca

SEQ ID NO: 2828 - RNA, 19 nt, artificial sequence
  siRNA antisense sequence
ugaccacugcacugggacc

SEQ ID NO: 2829 - RNA, 19 nt, artificial sequence
  siRNA sense sequence
gucccagugcaguggucac

SEQ ID NO: 2830 - RNA, 19 nt, artificial sequence
  siRNA antisense sequence
gugaccacugcacugggac

SEQ ID NO: 2831 - RNA, 19 nt, artificial sequence
  siRNA sense sequence
ucccagugcaguggucacc

SEQ ID NO: 2832 - RNA, 19 nt, artificial sequence
  siRNA antisense sequence
ggugaccacugcacuggga

SEQ ID NO: 2833 - RNA, 19 nt, artificial sequence
  siRNA sense sequence
cccagugcaguggucacca

SEQ ID NO: 2834 - RNA, 19 nt, artificial sequence
  siRNA antisense sequence
uggugaccacugcacuggg

SEQ ID NO: 2835 - RNA, 19 nt, artificial sequence
  siRNA sense sequence
ccagugcaguggucaccaa

SEQ ID NO: 2836 - RNA, 19 nt, artificial sequence
  siRNA antisense sequence
uuggugaccacugcacugg

SEQ ID NO: 2837 - RNA, 19 nt, artificial sequence
  siRNA sense sequence
cagugcaguggucaccaag

SEQ ID NO: 2838 - RNA, 19 nt, artificial sequence
  siRNA antisense sequence
cuuggugaccacugcacug

SEQ ID NO: 2839 - RNA, 19 nt, artificial sequence
  siRNA sense sequence
agugcaguggucaccaaga

SEQ ID NO: 2840 - RNA, 19 nt, artificial sequence
  siRNA antisense sequence
ucuuggugaccacugcacu

SEQ ID NO: 2841 - RNA, 19 nt, artificial sequence
  siRNA sense sequence
gugcaguggucaccaagaa

SEQ ID NO: 2842 - RNA, 19 nt, artificial sequence
  siRNA antisense sequence
uucuuggugaccacugcac

SEQ ID NO: 2843 - RNA, 19 nt, artificial sequence
  siRNA sense sequence
agacauagcaggcaggaag

SEQ ID NO: 2844 - RNA, 19 nt, artificial sequence
  siRNA antisense sequence
cuuccugccugcuaugucu

SEQ ID NO: 2845 - RNA, 19 nt, artificial sequence
  siRNA sense sequence
acauagcaggcaggaagcu

SEQ ID NO: 2846 - RNA, 19 nt, artificial sequence
  siRNA antisense sequence
agcuuccugccugcuaugu

SEQ ID NO: 2847 - RNA, 19 nt, artificial sequence
  siRNA sense sequence
cauagcaggcaggaagcuu

SEQ ID NO: 2848 - RNA, 19 nt, artificial sequence
  siRNA antisense sequence
aagcuuccugccugcuaug

SEQ ID NO: 2849 - RNA, 19 nt, artificial sequence
  siRNA sense sequence
auagcaggcaggaagcuuc

SEQ ID NO: 2850 - RNA, 19 nt, artificial sequence
  siRNA antisense sequence
gaagcuuccugccugcuau

SEQ ID NO: 2851 - RNA, 19 nt, artificial sequence
  siRNA sense sequence
uagcaggcaggaagcuucu

SEQ ID NO: 2852 - RNA, 19 nt, artificial sequence
  siRNA antisense sequence
agaagcuuccugccugcua

SEQ ID NO: 2853 - RNA, 19 nt, artificial sequence
  siRNA sense sequence
gcaggcaggaagcuucucu

SEQ ID NO: 2854 - RNA, 19 nt, artificial sequence
  siRNA antisense sequence
agagaagcuuccugccugc

SEQ ID NO: 2855 - RNA, 19 nt, artificial sequence
  siRNA sense sequence
gccgcagucucugaauccu

SEQ ID NO: 2856 - RNA, 19 nt, artificial sequence
  siRNA antisense sequence
aggauucagagacugcggc

SEQ ID NO: 2857 - RNA, 19 nt, artificial sequence
  siRNA sense sequence
ccgcagucucugaauccua

SEQ ID NO: 2858 - RNA, 19 nt, artificial sequence
  siRNA antisense sequence
uaggauucagagacugcgg

SEQ ID NO: 2859 - RNA, 19 nt, artificial sequence
  siRNA sense sequence
cgcagucucugaauccuau

SEQ ID NO: 2860 - RNA, 19 nt, artificial sequence
  siRNA antisense sequence
auaggauucagagacugcg

SEQ ID NO: 2861 - RNA, 19 nt, artificial sequence
  siRNA sense sequence
gcagucucugaauccuauc

SEQ ID NO: 2862 - RNA, 19 nt, artificial sequence
  siRNA antisense sequence
gauaggauucagagacugc

SEQ ID NO: 2863 - RNA, 19 nt, artificial sequence
  siRNA sense sequence
cagucucugaauccuauca

SEQ ID NO: 2864 - RNA, 19 nt, artificial sequence
  siRNA antisense sequence
ugauaggauucagagacug

SEQ ID NO: 2865 - RNA, 19 nt, artificial sequence
  siRNA sense sequence
aaggcugucucuuccacua

SEQ ID NO: 2866 - RNA, 19 nt, artificial sequence
  siRNA antisense sequence
uaguggaagagacagccuu

SEQ ID NO: 2867 - RNA, 19 nt, artificial sequence
  siRNA sense sequence
aggcugucucuuccacuau

SEQ ID NO: 2868 - RNA, 19 nt, artificial sequence
  siRNA antisense sequence
auaguggaagagacagccu

SEQ ID NO: 2869 - RNA, 19 nt, artificial sequence
  siRNA sense sequence
ggcugucucuuccacuaug

SEQ ID NO: 2870 - RNA, 19 nt, artificial sequence
  siRNA antisense sequence
cauaguggaagagacagcc

SEQ ID NO: 2871 - RNA, 19 nt, artificial sequence
  siRNA sense sequence
gcugucucuuccacuaugc

SEQ ID NO: 2872 - RNA, 19 nt, artificial sequence
  siRNA antisense sequence
gcauaguggaagagacagc

SEQ ID NO: 2873 - RNA, 19 nt, artificial sequence
  siRNA sense sequence
cugucucuuccacuaugcu

SEQ ID NO: 2874 - RNA, 19 nt, artificial sequence
  siRNA antisense sequence
agcauaguggaagagacag

SEQ ID NO: 2875 - RNA, 19 nt, artificial sequence
  siRNA sense sequence
ugucucuuccacuaugcuc

SEQ ID NO: 2876 - RNA, 19 nt, artificial sequence
  siRNA antisense sequence
gagcauaguggaagagaca

SEQ ID NO: 2877 - RNA, 19 nt, artificial sequence
  siRNA sense sequence
gucucuuccacuaugcucu

SEQ ID NO: 2878 - RNA, 19 nt, artificial sequence
  siRNA antisense sequence
agagcauaguggaagagac

SEQ ID NO: 2879 - RNA, 19 nt, artificial sequence
  siRNA sense sequence
ucucuuccacuaugcucuu

SEQ ID NO: 2880 - RNA, 19 nt, artificial sequence
  siRNA antisense sequence
aagagcauaguggaagaga

SEQ ID NO: 2881 - RNA, 19 nt, artificial sequence
  siRNA sense sequence
cucuuccacuaugcucuuu

SEQ ID NO: 2882 - RNA, 19 nt, artificial sequence
  siRNA antisense sequence
aaagagcauaguggaagag

SEQ ID NO: 2883 - RNA, 19 nt, artificial sequence
  siRNA sense sequence
cuuccacuaugcucuuuga

SEQ ID NO: 2884 - RNA, 19 nt, artificial sequence
  siRNA antisense sequence
ucaaagagcauaguggaag

SEQ ID NO: 2885 - RNA, 19 nt, artificial sequence
  siRNA sense sequence
uuccacuaugcucuuugau

SEQ ID NO: 2886 - RNA, 19 nt, artificial sequence
  siRNA antisense sequence
aucaaagagcauaguggaa

SEQ ID NO: 2887 - RNA, 19 nt, artificial sequence
  siRNA sense sequence
uccacuaugcucuuugaua

SEQ ID NO: 2888 - RNA, 19 nt, artificial sequence
  siRNA antisense sequence
uaucaaagagcauagugga

SEQ ID NO: 2889 - RNA, 19 nt, artificial sequence
  siRNA sense sequence
agaauacagagcuuaaauc

SEQ ID NO: 2890 - RNA, 19 nt, artificial sequence
  siRNA antisense sequence
gauuuaagcucuguauucu

SEQ ID NO: 2891 - RNA, 19 nt, artificial sequence
  siRNA sense sequence
uacagagcuuaaauccugc

SEQ ID NO: 2892 - RNA, 19 nt, artificial sequence
  siRNA antisense sequence
gcaggauuuaagcucugua

SEQ ID NO: 2893 - RNA, 19 nt, artificial sequence
  siRNA sense sequence
acagagcuuaaauccugca

SEQ ID NO: 2894 - RNA, 19 nt, artificial sequence
  siRNA antisense sequence
ugcaggauuuaagcucugu

SEQ ID NO: 2895 - RNA, 19 nt, artificial sequence
  siRNA sense sequence
cagagcuuaaauccugcau

SEQ ID NO: 2896 - RNA, 19 nt, artificial sequence
  siRNA antisense sequence
augcaggauuuaagcucug

SEQ ID NO: 2897 - RNA, 19 nt, artificial sequence
  siRNA sense sequence
agagcuuaaauccugcaua

SEQ ID NO: 2898 - RNA, 19 nt, artificial sequence
  siRNA antisense sequence
uaugcaggauuuaagcucu

SEQ ID NO: 2899 - RNA, 19 nt, artificial sequence
  siRNA sense sequence
gagcuuaaauccugcauaa

SEQ ID NO: 2900 - RNA, 19 nt, artificial sequence
  siRNA antisense sequence
uuaugcaggauuuaagcuc

SEQ ID NO: 2901 - RNA, 19 nt, artificial sequence
  siRNA sense sequence
agcuuaaauccugcauaaa

SEQ ID NO: 2902 - RNA, 19 nt, artificial sequence
  siRNA antisense sequence
uuuaugcaggauuuaagcu

SEQ ID NO: 2903 - RNA, 19 nt, artificial sequence
  siRNA sense sequence
gcuuaaauccugcauaaag

SEQ ID NO: 2904 - RNA, 19 nt, artificial sequence
  siRNA antisense sequence
cuuuaugcaggauuuaagc

SEQ ID NO: 2905 - RNA, 19 nt, artificial sequence
  siRNA sense sequence
uaaauccugcauaaaguag

SEQ ID NO: 2906 - RNA, 19 nt, artificial sequence
  siRNA antisense sequence
cuacuuuaugcaggauuua

SEQ ID NO: 2907 - RNA, 19 nt, artificial sequence
  siRNA sense sequence
aaauccugcauaaaguagc

SEQ ID NO: 2908 - RNA, 19 nt, artificial sequence
  siRNA antisense sequence
gcuacuuuaugcaggauuu

SEQ ID NO: 2909 - RNA, 19 nt, artificial sequence
  siRNA sense sequence
aauccugcauaaaguagca

SEQ ID NO: 2910 - RNA, 19 nt, artificial sequence
  siRNA antisense sequence
ugcuacuuuaugcaggauu

SEQ ID NO: 2911 - RNA, 19 nt, artificial sequence
  siRNA sense sequence
gcauaaaguagcagcucca

SEQ ID NO: 2912 - RNA, 19 nt, artificial sequence
  siRNA antisense sequence
uggagcugcuacuuuaugc

SEQ ID NO: 2913 - RNA, 19 nt, artificial sequence
  siRNA sense sequence
aaguagcagcuccauggcc

SEQ ID NO: 2914 - RNA, 19 nt, artificial sequence
  siRNA antisense sequence
ggccauggagcugcuacuu

SEQ ID NO: 2915 - RNA, 19 nt, artificial sequence
  siRNA sense sequence
aguagcagcuccauggccc

SEQ ID NO: 2916 - RNA, 19 nt, artificial sequence
  siRNA antisense sequence
gggccauggagcugcuacu

SEQ ID NO: 2917 - RNA, 19 nt, artificial sequence
  siRNA sense sequence
guagcagcuccauggcccu

SEQ ID NO: 2918 - RNA, 19 nt, artificial sequence
  siRNA antisense sequence
agggccauggagcugcuac

SEQ ID NO: 2919 - RNA, 19 nt, artificial sequence
  siRNA sense sequence
uagcagcuccauggcccua

SEQ ID NO: 2920 - RNA, 19 nt, artificial sequence
  siRNA antisense sequence
uagggccauggagcugcua

SEQ ID NO: 2921 - RNA, 19 nt, artificial sequence
  siRNA sense sequence
agcagcuccauggcccuag

SEQ ID NO: 2922 - RNA, 19 nt, artificial sequence
  siRNA antisense sequence
cuagggccauggagcugcu

SEQ ID NO: 2923 - RNA, 19 nt, artificial sequence
  siRNA sense sequence
gcagcuccauggcccuaga

SEQ ID NO: 2924 - RNA, 19 nt, artificial sequence
  siRNA antisense sequence
ucuagggccauggagcugc

SEQ ID NO: 2925 - RNA, 19 nt, artificial sequence
  siRNA sense sequence
cagcuccauggcccuagag

SEQ ID NO: 2926 - RNA, 19 nt, artificial sequence
  siRNA antisense sequence
cucuagggccauggagcug

SEQ ID NO: 2927 - RNA, 19 nt, artificial sequence
  siRNA sense sequence
agcuccauggcccuagagu

SEQ ID NO: 2928 - RNA, 19 nt, artificial sequence
  siRNA antisense sequence
acucuagggccauggagcu

SEQ ID NO: 2929 - RNA, 19 nt, artificial sequence
  siRNA sense sequence
gcuccauggcccuagagua

SEQ ID NO: 2930 - RNA, 19 nt, artificial sequence
  siRNA antisense sequence
uacucuagggccauggagc

SEQ ID NO: 2931 - RNA, 19 nt, artificial sequence
  siRNA sense sequence
uccauggcccuagaguaaa

SEQ ID NO: 2932 - RNA, 19 nt, artificial sequence
  siRNA antisense sequence
uuuacucuagggccaugga

SEQ ID NO: 2933 - RNA, 19 nt, artificial sequence
  siRNA sense sequence
ccauggcccuagaguaaaa

SEQ ID NO: 2934 - RNA, 19 nt, artificial sequence
  siRNA antisense sequence
uuuuacucuagggccaugg

SEQ ID NO: 2935 - RNA, 19 nt, artificial sequence
  siRNA sense sequence
aacuggccagucugaugcu

SEQ ID NO: 2936 - RNA, 19 nt, artificial sequence
  siRNA antisense sequence
agcaucagacuggccaguu

SEQ ID NO: 2937 - RNA, 19 nt, artificial sequence
  siRNA sense sequence
cuggccagucugaugcucu

SEQ ID NO: 2938 - RNA, 19 nt, artificial sequence
  siRNA antisense sequence
agagcaucagacuggccag

SEQ ID NO: 2939 - RNA, 19 nt, artificial sequence
  siRNA sense sequence
uggccagucugaugcucuc

SEQ ID NO: 2940 - RNA, 19 nt, artificial sequence
  siRNA antisense sequence
gagagcaucagacuggcca

SEQ ID NO: 2941 - RNA, 19 nt, artificial sequence
  siRNA sense sequence
ggccagucugaugcucuca

SEQ ID NO: 2942 - RNA, 19 nt, artificial sequence
  siRNA antisense sequence
ugagagcaucagacuggcc

SEQ ID NO: 2943 - RNA, 19 nt, artificial sequence
  siRNA sense sequence
gccagucugaugcucucau

SEQ ID NO: 2944 - RNA, 19 nt, artificial sequence
  siRNA antisense sequence
augagagcaucagacuggc

SEQ ID NO: 2945 - RNA, 19 nt, artificial sequence
  siRNA sense sequence
ccagucugaugcucucauu

SEQ ID NO: 2946 - RNA, 19 nt, artificial sequence
  siRNA antisense sequence
aaugagagcaucagacugg

SEQ ID NO: 2947 - RNA, 19 nt, artificial sequence
  siRNA sense sequence
cagucugaugcucucauuu

SEQ ID NO: 2948 - RNA, 19 nt, artificial sequence
  siRNA antisense sequence
aaaugagagcaucagacug

SEQ ID NO: 2949 - RNA, 19 nt, artificial sequence
  siRNA sense sequence
aggaaggccucaaagguuc

SEQ ID NO: 2950 - RNA, 19 nt, artificial sequence
  siRNA antisense sequence
gaaccuuugaggccuuccu

SEQ ID NO: 2951 - RNA, 19 nt, artificial sequence
  siRNA sense sequence
ggaaggccucaaagguucu

SEQ ID NO: 2952 - RNA, 19 nt, artificial sequence
  siRNA antisense sequence
agaaccuuugaggccuucc

SEQ ID NO: 2953 - RNA, 19 nt, artificial sequence
  siRNA sense sequence
gaaggccucaaagguucuu

SEQ ID NO: 2954 - RNA, 19 nt, artificial sequence
  siRNA antisense sequence
aagaaccuuugaggccuuc

SEQ ID NO: 2955 - RNA, 19 nt, artificial sequence
  siRNA sense sequence
aaggccucaaagguucuuc

SEQ ID NO: 2956 - RNA, 19 nt, artificial sequence
  siRNA antisense sequence
gaagaaccuuugaggccuu

SEQ ID NO: 2957 - RNA, 19 nt, artificial sequence
  siRNA sense sequence
aggccucaaagguucuucu

SEQ ID NO: 2958 - RNA, 19 nt, artificial sequence
  siRNA antisense sequence
agaagaaccuuugaggccu

SEQ ID NO: 2959 - RNA, 19 nt, artificial sequence
  siRNA sense sequence
ggccucaaagguucuucug

SEQ ID NO: 2960 - RNA, 19 nt, artificial sequence
  siRNA antisense sequence
cagaagaaccuuugaggcc

SEQ ID NO: 2961 - RNA, 19 nt, artificial sequence
  siRNA sense sequence
gccucaaagguucuucuga

SEQ ID NO: 2962 - RNA, 19 nt, artificial sequence
  siRNA antisense sequence
ucagaagaaccuuugaggc

SEQ ID NO: 2963 - RNA, 19 nt, artificial sequence
  siRNA sense sequence
gguucuucugaguguuuug

SEQ ID NO: 2964 - RNA, 19 nt, artificial sequence
  siRNA antisense sequence
caaaacacucagaagaacc

SEQ ID NO: 2965 - RNA, 19 nt, artificial sequence
  siRNA sense sequence
guucuucugaguguuuuga

SEQ ID NO: 2966 - RNA, 19 nt, artificial sequence
  siRNA antisense sequence
ucaaaacacucagaagaac

SEQ ID NO: 2967 - RNA, 19 nt, artificial sequence
  siRNA sense sequence
uucugaguguuuugaggug

SEQ ID NO: 2968 - RNA, 19 nt, artificial sequence
  siRNA antisense sequence
caccucaaaacacucagaa

SEQ ID NO: 2969 - RNA, 19 nt, artificial sequence
  siRNA sense sequence
ucugaguguuuugaggugc

SEQ ID NO: 2970 - RNA, 19 nt, artificial sequence
  siRNA antisense sequence
gcaccucaaaacacucaga

SEQ ID NO: 2971 - RNA, 19 nt, artificial sequence
  siRNA sense sequence
aguguuuugaggugcuagc

SEQ ID NO: 2972 - RNA, 19 nt, artificial sequence
  siRNA antisense sequence
gcuagcaccucaaaacacu

SEQ ID NO: 2973 - RNA, 19 nt, artificial sequence
  siRNA sense sequence
guguuuugaggugcuagcu

SEQ ID NO: 2974 - RNA, 19 nt, artificial sequence
  siRNA antisense sequence
agcuagcaccucaaaacac

SEQ ID NO: 2975 - RNA, 19 nt, artificial sequence
  siRNA sense sequence
uguuuugaggugcuagcug

SEQ ID NO: 2976 - RNA, 19 nt, artificial sequence
  siRNA antisense sequence
cagcuagcaccucaaaaca

SEQ ID NO: 2977 - RNA, 19 nt, artificial sequence
  siRNA sense sequence
guuuugaggugcuagcugg

SEQ ID NO: 2978 - RNA, 19 nt, artificial sequence
  siRNA antisense sequence
ccagcuagcaccucaaaac

SEQ ID NO: 2979 - RNA, 19 nt, artificial sequence
  siRNA sense sequence
uuuugaggugcuagcugga

SEQ ID NO: 2980 - RNA, 19 nt, artificial sequence
  siRNA antisense sequence
uccagcuagcaccucaaaa

SEQ ID NO: 2981 - RNA, 19 nt, artificial sequence
  siRNA sense sequence
gaggugcuagcuggaugga

SEQ ID NO: 2982 - RNA, 19 nt, artificial sequence
  siRNA antisense sequence
uccauccagcuagcaccuc

SEQ ID NO: 2983 - RNA, 19 nt, artificial sequence
  siRNA sense sequence
aggugcuagcuggauggaa

SEQ ID NO: 2984 - RNA, 19 nt, artificial sequence
  siRNA antisense sequence
uuccauccagcuagcaccu

SEQ ID NO: 2985 - RNA, 19 nt, artificial sequence
  siRNA sense sequence
gugcuagcuggauggaagg

SEQ ID NO: 2986 - RNA, 19 nt, artificial sequence
  siRNA antisense sequence
ccuuccauccagcuagcac

SEQ ID NO: 2987 - RNA, 19 nt, artificial sequence
  siRNA sense sequence
ugcuagcuggauggaaggg

SEQ ID NO: 2988 - RNA, 19 nt, artificial sequence
  siRNA antisense sequence
cccuuccauccagcuagca

SEQ ID NO: 2989 - RNA, 19 nt, artificial sequence
  siRNA sense sequence
cuaucucccuuaauuaugg

SEQ ID NO: 2990 - RNA, 19 nt, artificial sequence
  siRNA antisense sequence
ccauaauuaagggagauag

SEQ ID NO: 2991 - RNA, 19 nt, artificial sequence
  siRNA sense sequence
uaucucccuuaauuauggu

SEQ ID NO: 2992 - RNA, 19 nt, artificial sequence
  siRNA antisense sequence
accauaauuaagggagaua

SEQ ID NO: 2993 - RNA, 19 nt, artificial sequence
  siRNA sense sequence
aucucccuuaauuaugguc

SEQ ID NO: 2994 - RNA, 19 nt, artificial sequence
  siRNA antisense sequence
gaccauaauuaagggagau

SEQ ID NO: 2995 - RNA, 19 nt, artificial sequence
  siRNA sense sequence
ucucccuuaauuauggucu

SEQ ID NO: 2996 - RNA, 19 nt, artificial sequence
  siRNA antisense sequence
agaccauaauuaagggaga

SEQ ID NO: 2997 - RNA, 19 nt, artificial sequence
  siRNA sense sequence
cucccuuaauuauggucuc

SEQ ID NO: 2998 - RNA, 19 nt, artificial sequence
  siRNA antisense sequence
gagaccauaauuaagggag

SEQ ID NO: 2999 - RNA, 19 nt, artificial sequence
  siRNA sense sequence
cccuuaauuauggucucag

SEQ ID NO: 3000 - RNA, 19 nt, artificial sequence
  siRNA antisense sequence
cugagaccauaauuaaggg

SEQ ID NO: 3001 - RNA, 19 nt, artificial sequence
  siRNA sense sequence
ccuuaauuauggucucagg

SEQ ID NO: 3002 - RNA, 19 nt, artificial sequence
  siRNA antisense sequence
ccugagaccauaauuaagg

SEQ ID NO: 3003 - RNA, 19 nt, artificial sequence
  siRNA sense sequence
cuuaauuauggucucaggu

SEQ ID NO: 3004 - RNA, 19 nt, artificial sequence
  siRNA antisense sequence
accugagaccauaauuaag

SEQ ID NO: 3005 - RNA, 19 nt, artificial sequence
  siRNA sense sequence
uuaauuauggucucaggug

SEQ ID NO: 3006 - RNA, 19 nt, artificial sequence
  siRNA antisense sequence
caccugagaccauaauuaa

SEQ ID NO: 3007 - RNA, 19 nt, artificial sequence
  siRNA sense sequence
uaauuauggucucaggugg

SEQ ID NO: 3008 - RNA, 19 nt, artificial sequence
  siRNA antisense sequence
ccaccugagaccauaauua

SEQ ID NO: 3009 - RNA, 19 nt, artificial sequence
  siRNA sense sequence
aauuauggucucagguggc

SEQ ID NO: 3010 - RNA, 19 nt, artificial sequence
  siRNA antisense sequence
gccaccugagaccauaauu

SEQ ID NO: 3011 - RNA, 19 nt, artificial sequence
  siRNA sense sequence
auuauggucucagguggca

SEQ ID NO: 3012 - RNA, 19 nt, artificial sequence
  siRNA antisense sequence
ugccaccugagaccauaau

SEQ ID NO: 3013 - RNA, 19 nt, artificial sequence
  siRNA sense sequence
uuauggucucagguggcag

SEQ ID NO: 3014 - RNA, 19 nt, artificial sequence
  siRNA antisense sequence
cugccaccugagaccauaa

SEQ ID NO: 3015 - RNA, 19 nt, artificial sequence
  siRNA sense sequence
uauggucucagguggcagu

SEQ ID NO: 3016 - RNA, 19 nt, artificial sequence
  siRNA antisense sequence
acugccaccugagaccaua

SEQ ID NO: 3017 - RNA, 19 nt, artificial sequence
  siRNA sense sequence
auggucucagguggcagua

SEQ ID NO: 3018 - RNA, 19 nt, artificial sequence
  siRNA antisense sequence
uacugccaccugagaccau

SEQ ID NO: 3019 - RNA, 19 nt, artificial sequence
  siRNA sense sequence
uggucucagguggcaguag

SEQ ID NO: 3020 - RNA, 19 nt, artificial sequence
  siRNA antisense sequence
cuacugccaccugagacca

SEQ ID NO: 3021 - RNA, 19 nt, artificial sequence
  siRNA sense sequence
ggucucagguggcaguagc

SEQ ID NO: 3022 - RNA, 19 nt, artificial sequence
  siRNA antisense sequence
gcuacugccaccugagacc

SEQ ID NO: 3023 - RNA, 19 nt, artificial sequence
  siRNA sense sequence
gucucagguggcaguagcc

SEQ ID NO: 3024 - RNA, 19 nt, artificial sequence
  siRNA antisense sequence
ggcuacugccaccugagac

SEQ ID NO: 3025 - RNA, 19 nt, artificial sequence
  siRNA sense sequence
caguagccaccaucucuga

SEQ ID NO: 3026 - RNA, 19 nt, artificial sequence
  siRNA antisense sequence
ucagagaugguggcuacug

SEQ ID NO: 3027 - RNA, 19 nt, artificial sequence
  siRNA sense sequence
aguagccaccaucucugaa

SEQ ID NO: 3028 - RNA, 19 nt, artificial sequence
  siRNA antisense sequence
uucagagaugguggcuacu

SEQ ID NO: 3029 - RNA, 19 nt, artificial sequence
  siRNA sense sequence
ucacgacugauuuguuaua

SEQ ID NO: 3030 - RNA, 19 nt, artificial sequence
  siRNA antisense sequence
uauaacaaaucagucguga

SEQ ID NO: 3031 - RNA, 19 nt, artificial sequence
  siRNA sense sequence
cacgacugauuuguuauag

SEQ ID NO: 3032 - RNA, 19 nt, artificial sequence
  siRNA antisense sequence
cuauaacaaaucagucgug

SEQ ID NO: 3033 - RNA, 19 nt, artificial sequence
  siRNA sense sequence
cgacugauuuguuauagug

SEQ ID NO: 3034 - RNA, 19 nt, artificial sequence
  siRNA antisense sequence
cacuauaacaaaucagucg

SEQ ID NO: 3035 - RNA, 19 nt, artificial sequence
  siRNA sense sequence
gacugauuuguuauagugg

SEQ ID NO: 3036 - RNA, 19 nt, artificial sequence
  siRNA antisense sequence
ccacuauaacaaaucaguc

SEQ ID NO: 3037 - RNA, 19 nt, artificial sequence
  siRNA sense sequence
gcggcugucuaagaagucu

SEQ ID NO: 3038 - RNA, 19 nt, artificial sequence
  siRNA antisense sequence
agacuucuuagacagccgc

SEQ ID NO: 3039 - RNA, 19 nt, artificial sequence
  siRNA sense sequence
cggcugucuaagaagucug

SEQ ID NO: 3040 - RNA, 19 nt, artificial sequence
  siRNA antisense sequence
cagacuucuuagacagccg

SEQ ID NO: 3041 - RNA, 19 nt, artificial sequence
  siRNA sense sequence
ggcugucuaagaagucuga

SEQ ID NO: 3042 - RNA, 19 nt, artificial sequence
  siRNA antisense sequence
ucagacuucuuagacagcc

SEQ ID NO: 3043 - RNA, 19 nt, artificial sequence
  siRNA sense sequence
gcugucuaagaagucugaa

SEQ ID NO: 3044 - RNA, 19 nt, artificial sequence
  siRNA antisense sequence
uucagacuucuuagacagc

SEQ ID NO: 3045 - RNA, 19 nt, artificial sequence
  siRNA sense sequence
ucuaagaagucugaaucua

SEQ ID NO: 3046 - RNA, 19 nt, artificial sequence
  siRNA antisense sequence
uagauucagacuucuuaga

SEQ ID NO: 3047 - RNA, 19 nt, artificial sequence
  siRNA sense sequence
cuaagaagucugaaucuau

SEQ ID NO: 3048 - RNA, 19 nt, artificial sequence
  siRNA antisense sequence
auagauucagacuucuuag

SEQ ID NO: 3049 - RNA, 19 nt, artificial sequence
  siRNA sense sequence
uaagaagucugaaucuauc

SEQ ID NO: 3050 - RNA, 19 nt, artificial sequence
  siRNA antisense sequence
gauagauucagacuucuua

SEQ ID NO: 3051 - RNA, 19 nt, artificial sequence
  siRNA sense sequence
aagaagucugaaucuaucu

SEQ ID NO: 3052 - RNA, 19 nt, artificial sequence
  siRNA antisense sequence
agauagauucagacuucuu

SEQ ID NO: 3053 - RNA, 19 nt, artificial sequence
  siRNA sense sequence
agaagucugaaucuaucug

SEQ ID NO: 3054 - RNA, 19 nt, artificial sequence
  siRNA antisense sequence
cagauagauucagacuucu

SEQ ID NO: 3055 - RNA, 19 nt, artificial sequence
  siRNA sense sequence
gaagucugaaucuaucuga

SEQ ID NO: 3056 - RNA, 19 nt, artificial sequence
  siRNA antisense sequence
ucagauagauucagacuuc

SEQ ID NO: 3057 - RNA, 19 nt, artificial sequence
  siRNA sense sequence
aagucugaaucuaucugac

SEQ ID NO: 3058 - RNA, 19 nt, artificial sequence
  siRNA antisense sequence
gucagauagauucagacuu

SEQ ID NO: 3059 - RNA, 19 nt, artificial sequence
  siRNA sense sequence
agucugaaucuaucugaca

SEQ ID NO: 3060 - RNA, 19 nt, artificial sequence
  siRNA antisense sequence
ugucagauagauucagacu

SEQ ID NO: 3061 - RNA, 19 nt, artificial sequence
  siRNA sense sequence
gucugaaucuaucugacag

SEQ ID NO: 3062 - RNA, 19 nt, artificial sequence
  siRNA antisense sequence
cugucagauagauucagac

SEQ ID NO: 3063 - RNA, 19 nt, artificial sequence
  siRNA sense sequence
ucugaaucuaucugacagg

SEQ ID NO: 3064 - RNA, 19 nt, artificial sequence
  siRNA antisense sequence
ccugucagauagauucaga

SEQ ID NO: 3065 - RNA, 19 nt, artificial sequence
  siRNA sense sequence
cugaaucuaucugacagga

SEQ ID NO: 3066 - RNA, 19 nt, artificial sequence
  siRNA antisense sequence
uccugucagauagauucag

SEQ ID NO: 3067 - RNA, 19 nt, artificial sequence
  siRNA sense sequence
ugaaucuaucugacaggag

SEQ ID NO: 3068 - RNA, 19 nt, artificial sequence
  siRNA antisense sequence
cuccugucagauagauuca

SEQ ID NO: 3069 - RNA, 19 nt, artificial sequence
  siRNA sense sequence
gaaucuaucugacaggagu

SEQ ID NO: 3070 - RNA, 19 nt, artificial sequence
  siRNA antisense sequence
acuccugucagauagauuc

SEQ ID NO: 3071 - RNA, 19 nt, artificial sequence
  siRNA sense sequence
aaucuaucugacaggagua

SEQ ID NO: 3072 - RNA, 19 nt, artificial sequence
  siRNA antisense sequence
uacuccugucagauagauu

SEQ ID NO: 3073 - RNA, 19 nt, artificial sequence
  siRNA sense sequence
aucuaucugacaggaguau

SEQ ID NO: 3074 - RNA, 19 nt, artificial sequence
  siRNA antisense sequence
auacuccugucagauagau

SEQ ID NO: 3075 - RNA, 19 nt, artificial sequence
  siRNA sense sequence
ucuaucugacaggaguauc

SEQ ID NO: 3076 - RNA, 19 nt, artificial sequence
  siRNA antisense sequence
gauacuccugucagauaga

SEQ ID NO: 3077 - RNA, 19 nt, artificial sequence
  siRNA sense sequence
cuaucugacaggaguaucu

SEQ ID NO: 3078 - RNA, 19 nt, artificial sequence
  siRNA antisense sequence
agauacuccugucagauag

SEQ ID NO: 3079 - RNA, 19 nt, artificial sequence
  siRNA sense sequence
uaucugacaggaguaucug

SEQ ID NO: 3080 - RNA, 19 nt, artificial sequence
  siRNA antisense sequence
cagauacuccugucagaua

SEQ ID NO: 3081 - RNA, 19 nt, artificial sequence
  siRNA sense sequence
caggaguaucuguuacgug

SEQ ID NO: 3082 - RNA, 19 nt, artificial sequence
  siRNA antisense sequence
cacguaacagauacuccug

SEQ ID NO: 3083 - RNA, 19 nt, artificial sequence
  siRNA sense sequence
aggaguaucuguuacgugg

SEQ ID NO: 3084 - RNA, 19 nt, artificial sequence
  siRNA antisense sequence
ccacguaacagauacuccu

SEQ ID NO: 3085 - RNA, 19 nt, artificial sequence
  siRNA sense sequence
ggaguaucuguuacguggc

SEQ ID NO: 3086 - RNA, 19 nt, artificial sequence
  siRNA antisense sequence
gccacguaacagauacucc

SEQ ID NO: 3087 - RNA, 19 nt, artificial sequence
  siRNA sense sequence
gaguaucuguuacguggcc

SEQ ID NO: 3088 - RNA, 19 nt, artificial sequence
  siRNA antisense sequence
ggccacguaacagauacuc

SEQ ID NO: 3089 - RNA, 19 nt, artificial sequence
  siRNA sense sequence
aguaucuguuacguggccc

SEQ ID NO: 3090 - RNA, 19 nt, artificial sequence
  siRNA antisense sequence
gggccacguaacagauacu

SEQ ID NO: 3091 - RNA, 19 nt, artificial sequence
  siRNA sense sequence
guaucuguuacguggcccu

SEQ ID NO: 3092 - RNA, 19 nt, artificial sequence
  siRNA antisense sequence
agggccacguaacagauac

SEQ ID NO: 3093 - RNA, 19 nt, artificial sequence
  siRNA sense sequence
uaucuguuacguggcccuc

SEQ ID NO: 3094 - RNA, 19 nt, artificial sequence
  siRNA antisense sequence
gagggccacguaacagaua

SEQ ID NO: 3095 - RNA, 19 nt, artificial sequence
  siRNA sense sequence
aucuguuacguggcccuca

SEQ ID NO: 3096 - RNA, 19 nt, artificial sequence
  siRNA antisense sequence
ugagggccacguaacagau

SEQ ID NO: 3097 - RNA, 19 nt, artificial sequence
  siRNA sense sequence
ucuguuacguggcccucau

SEQ ID NO: 3098 - RNA, 19 nt, artificial sequence
  siRNA antisense sequence
augagggccacguaacaga

SEQ ID NO: 3099 - RNA, 19 nt, artificial sequence
  siRNA sense sequence
cuguuacguggcccucaua

SEQ ID NO: 3100 - RNA, 19 nt, artificial sequence
  siRNA antisense sequence
uaugagggccacguaacag

SEQ ID NO: 3101 - RNA, 19 nt, artificial sequence
  siRNA sense sequence
uguuacguggcccucauac

SEQ ID NO: 3102 - RNA, 19 nt, artificial sequence
  siRNA antisense sequence
guaugagggccacguaaca

SEQ ID NO: 3103 - RNA, 19 nt, artificial sequence
  siRNA sense sequence
cguggcccucauacacugu

SEQ ID NO: 3104 - RNA, 19 nt, artificial sequence
  siRNA antisense sequence
acaguguaugagggccacg

SEQ ID NO: 3105 - RNA, 19 nt, artificial sequence
  siRNA sense sequence
guggcccucauacacugua

SEQ ID NO: 3106 - RNA, 19 nt, artificial sequence
  siRNA antisense sequence
uacaguguaugagggccac

SEQ ID NO: 3107 - RNA, 19 nt, artificial sequence
  siRNA sense sequence
uggcccucauacacuguaa

SEQ ID NO: 3108 - RNA, 19 nt, artificial sequence
  siRNA antisense sequence
uuacaguguaugagggcca

SEQ ID NO: 3109 - RNA, 19 nt, artificial sequence
  siRNA sense sequence
ggcccucauacacuguaac

SEQ ID NO: 3110 - RNA, 19 nt, artificial sequence
  siRNA antisense sequence
guuacaguguaugagggcc

SEQ ID NO: 3111 - RNA, 19 nt, artificial sequence
  siRNA sense sequence
acauuucuagaauucaugg

SEQ ID NO: 3112 - RNA, 19 nt, artificial sequence
  siRNA antisense sequence
ccaugaauucuagaaaugu

SEQ ID NO: 3113 - RNA, 19 nt, artificial sequence
  siRNA sense sequence
cauuucuagaauucauggc

SEQ ID NO: 3114 - RNA, 19 nt, artificial sequence
  siRNA antisense sequence
gccaugaauucuagaaaug

SEQ ID NO: 3115 - RNA, 19 nt, artificial sequence
  siRNA sense sequence
auuucuagaauucauggcc

SEQ ID NO: 3116 - RNA, 19 nt, artificial sequence
  siRNA antisense sequence
ggccaugaauucuagaaau

SEQ ID NO: 3117 - RNA, 19 nt, artificial sequence
  siRNA sense sequence
uuucuagaauucauggccc

SEQ ID NO: 3118 - RNA, 19 nt, artificial sequence
  siRNA antisense sequence
gggccaugaauucuagaaa

SEQ ID NO: 3119 - RNA, 19 nt, artificial sequence
  siRNA sense sequence
uucuagaauucauggccca

SEQ ID NO: 3120 - RNA, 19 nt, artificial sequence
  siRNA antisense sequence
ugggccaugaauucuagaa

SEQ ID NO: 3121 - RNA, 19 nt, artificial sequence
  siRNA sense sequence
ucuagaauucauggcccag

SEQ ID NO: 3122 - RNA, 19 nt, artificial sequence
  siRNA antisense sequence
cugggccaugaauucuaga

SEQ ID NO: 3123 - RNA, 19 nt, artificial sequence
  siRNA sense sequence
cuagaauucauggcccagc

SEQ ID NO: 3124 - RNA, 19 nt, artificial sequence
  siRNA antisense sequence
gcugggccaugaauucuag

SEQ ID NO: 3125 - RNA, 19 nt, artificial sequence
  siRNA sense sequence
uagaauucauggcccagcu

SEQ ID NO: 3126 - RNA, 19 nt, artificial sequence
  siRNA antisense sequence
agcugggccaugaauucua

SEQ ID NO: 3127 - RNA, 19 nt, artificial sequence
  siRNA sense sequence
agaauucauggcccagcua

SEQ ID NO: 3128 - RNA, 19 nt, artificial sequence
  siRNA antisense sequence
uagcugggccaugaauucu

SEQ ID NO: 3129 - RNA, 19 nt, artificial sequence
  siRNA sense sequence
gaauucauggcccagcuau

SEQ ID NO: 3130 - RNA, 19 nt, artificial sequence
  siRNA antisense sequence
auagcugggccaugaauuc

SEQ ID NO: 3131 - RNA, 19 nt, artificial sequence
  siRNA sense sequence
aauucauggcccagcuaua

SEQ ID NO: 3132 - RNA, 19 nt, artificial sequence
  siRNA antisense sequence
uauagcugggccaugaauu

SEQ ID NO: 3133 - RNA, 19 nt, artificial sequence
  siRNA sense sequence
auucauggcccagcuauag

SEQ ID NO: 3134 - RNA, 19 nt, artificial sequence
  siRNA antisense sequence
cuauagcugggccaugaau

SEQ ID NO: 3135 - RNA, 19 nt, artificial sequence
  siRNA sense sequence
uucauggcccagcuauagc

SEQ ID NO: 3136 - RNA, 19 nt, artificial sequence
  siRNA antisense sequence
gcuauagcugggccaugaa

SEQ ID NO: 3137 - RNA, 19 nt, artificial sequence
  siRNA sense sequence
ucauggcccagcuauagca

SEQ ID NO: 3138 - RNA, 19 nt, artificial sequence
  siRNA antisense sequence
ugcuauagcugggccauga

SEQ ID NO: 3139 - RNA, 19 nt, artificial sequence
  siRNA sense sequence
cauggcccagcuauagcag

SEQ ID NO: 3140 - RNA, 19 nt, artificial sequence
  siRNA antisense sequence
cugcuauagcugggccaug

SEQ ID NO: 3141 - RNA, 19 nt, artificial sequence
  siRNA sense sequence
auggcccagcuauagcaga

SEQ ID NO: 3142 - RNA, 19 nt, artificial sequence
  siRNA antisense sequence
ucugcuauagcugggccau

SEQ ID NO: 3143 - RNA, 19 nt, artificial sequence
  siRNA sense sequence
cccagcuauagcagaauaa

SEQ ID NO: 3144 - RNA, 19 nt, artificial sequence
  siRNA antisense sequence
uuauucugcuauagcuggg

SEQ ID NO: 3145 - RNA, 19 nt, artificial sequence
  siRNA sense sequence
aacgucccacuaaugcuau

SEQ ID NO: 3146 - RNA, 19 nt, artificial sequence
  siRNA antisense sequence
auagcauuagugggacguu

SEQ ID NO: 3147 - RNA, 19 nt, artificial sequence
  siRNA sense sequence
acgucccacuaaugcuauc

SEQ ID NO: 3148 - RNA, 19 nt, artificial sequence
  siRNA antisense sequence
gauagcauuagugggacgu

SEQ ID NO: 3149 - RNA, 19 nt, artificial sequence
  siRNA sense sequence
cgucccacuaaugcuaucc

SEQ ID NO: 3150 - RNA, 19 nt, artificial sequence
  siRNA antisense sequence
ggauagcauuagugggacg

SEQ ID NO: 3151 - RNA, 19 nt, artificial sequence
  siRNA sense sequence
ccacuaaugcuauccaggu

SEQ ID NO: 3152 - RNA, 19 nt, artificial sequence
  siRNA antisense sequence
accuggauagcauuagugg

SEQ ID NO: 3153 - RNA, 19 nt, artificial sequence
  siRNA sense sequence
cacuaaugcuauccaggug

SEQ ID NO: 3154 - RNA, 19 nt, artificial sequence
  siRNA antisense sequence
caccuggauagcauuagug

SEQ ID NO: 3155 - RNA, 19 nt, artificial sequence
  siRNA sense sequence
acuaaugcuauccagguga

SEQ ID NO: 3156 - RNA, 19 nt, artificial sequence
  siRNA antisense sequence
ucaccuggauagcauuagu

SEQ ID NO: 3157 - RNA, 19 nt, artificial sequence
  siRNA sense sequence
cuaaugcuauccaggugaa

SEQ ID NO: 3158 - RNA, 19 nt, artificial sequence
  siRNA antisense sequence
uucaccuggauagcauuag

SEQ ID NO: 3159 - RNA, 19 nt, artificial sequence
  siRNA sense sequence
uaaugcuauccaggugaag

SEQ ID NO: 3160 - RNA, 19 nt, artificial sequence
  siRNA antisense sequence
cuucaccuggauagcauua

SEQ ID NO: 3161 - RNA, 19 nt, artificial sequence
  siRNA sense sequence
auccaggugaagggcuucc

SEQ ID NO: 3162 - RNA, 19 nt, artificial sequence
  siRNA antisense sequence
ggaagcccuucaccuggau

SEQ ID NO: 3163 - RNA, 19 nt, artificial sequence
  siRNA sense sequence
ccucugcuccaccgcuagu

SEQ ID NO: 3164 - RNA, 19 nt, artificial sequence
  siRNA antisense sequence
acuagcgguggagcagagg

SEQ ID NO: 3165 - RNA, 19 nt, artificial sequence
  siRNA sense sequence
cucugcuccaccgcuagua

SEQ ID NO: 3166 - RNA, 19 nt, artificial sequence
  siRNA antisense sequence
uacuagcgguggagcagag

SEQ ID NO: 3167 - RNA, 19 nt, artificial sequence
  siRNA sense sequence
ucugcuccaccgcuaguaa

SEQ ID NO: 3168 - RNA, 19 nt, artificial sequence
  siRNA antisense sequence
uuacuagcgguggagcaga

SEQ ID NO: 3169 - RNA, 19 nt, artificial sequence
  siRNA sense sequence
cugcuccaccgcuaguaaa

SEQ ID NO: 3170 - RNA, 19 nt, artificial sequence
  siRNA antisense sequence
uuuacuagcgguggagcag

SEQ ID NO: 3171 - RNA, 19 nt, artificial sequence
  siRNA sense sequence
ugcuccaccgcuaguaaag

SEQ ID NO: 3172 - RNA, 19 nt, artificial sequence
  siRNA antisense sequence
cuuuacuagcgguggagca

SEQ ID NO: 3173 - RNA, 19 nt, artificial sequence
  siRNA sense sequence
gcuccaccgcuaguaaagc

SEQ ID NO: 3174 - RNA, 19 nt, artificial sequence
  siRNA antisense sequence
gcuuuacuagcgguggagc

SEQ ID NO: 3175 - RNA, 19 nt, artificial sequence
  siRNA sense sequence
cuccaccgcuaguaaagcc

SEQ ID NO: 3176 - RNA, 19 nt, artificial sequence
  siRNA antisense sequence
ggcuuuacuagcgguggag

SEQ ID NO: 3177 - RNA, 19 nt, artificial sequence
  siRNA sense sequence
uccaccgcuaguaaagcca

SEQ ID NO: 3178 - RNA, 19 nt, artificial sequence
  siRNA antisense sequence
uggcuuuacuagcggugga

SEQ ID NO: 3179 - RNA, 19 nt, artificial sequence
  siRNA sense sequence
ccaccgcuaguaaagccaa

SEQ ID NO: 3180 - RNA, 19 nt, artificial sequence
  siRNA antisense sequence
uuggcuuuacuagcggugg

SEQ ID NO: 3181 - RNA, 19 nt, artificial sequence
  siRNA sense sequence
caccgcuaguaaagccaaa

SEQ ID NO: 3182 - RNA, 19 nt, artificial sequence
  siRNA antisense sequence
uuuggcuuuacuagcggug

SEQ ID NO: 3183 - RNA, 19 nt, artificial sequence
  siRNA sense sequence
accgcuaguaaagccaaaa

SEQ ID NO: 3184 - RNA, 19 nt, artificial sequence
  siRNA antisense sequence
uuuuggcuuuacuagcggu

SEQ ID NO: 3185 - RNA, 19 nt, artificial sequence
  siRNA sense sequence
ccgcuaguaaagccaaaau

SEQ ID NO: 3186 - RNA, 19 nt, artificial sequence
  siRNA antisense sequence
auuuuggcuuuacuagcgg

SEQ ID NO: 3187 - RNA, 19 nt, artificial sequence
  siRNA sense sequence
cgcuaguaaagccaaaaua

SEQ ID NO: 3188 - RNA, 19 nt, artificial sequence
  siRNA antisense sequence
uauuuuggcuuuacuagcg

SEQ ID NO: 3189 - RNA, 19 nt, artificial sequence
  siRNA sense sequence
gcuaguaaagccaaaauac

SEQ ID NO: 3190 - RNA, 19 nt, artificial sequence
  siRNA antisense sequence
guauuuuggcuuuacuagc

SEQ ID NO: 3191 - RNA, 19 nt, artificial sequence
  siRNA sense sequence
cuaguaaagccaaaauaca

SEQ ID NO: 3192 - RNA, 19 nt, artificial sequence
  siRNA antisense sequence
uguauuuuggcuuuacuag

SEQ ID NO: 3193 - RNA, 19 nt, artificial sequence
  siRNA sense sequence
auauccaccucucccaaau

SEQ ID NO: 3194 - RNA, 19 nt, artificial sequence
  siRNA antisense sequence
auuugggagagguggauau

SEQ ID NO: 3195 - RNA, 19 nt, artificial sequence
  siRNA sense sequence
uauccaccucucccaaaug

SEQ ID NO: 3196 - RNA, 19 nt, artificial sequence
  siRNA antisense sequence
cauuugggagagguggaua

SEQ ID NO: 3197 - RNA, 19 nt, artificial sequence
  siRNA sense sequence
ucucccaaaugcagacacu

SEQ ID NO: 3198 - RNA, 19 nt, artificial sequence
  siRNA antisense sequence
agugucugcauuugggaga

SEQ ID NO: 3199 - RNA, 19 nt, artificial sequence
  siRNA sense sequence
cucccaaaugcagacacug

SEQ ID NO: 3200 - RNA, 19 nt, artificial sequence
  siRNA antisense sequence
cagugucugcauuugggag

SEQ ID NO: 3201 - RNA, 19 nt, artificial sequence
  siRNA sense sequence
ucccaaaugcagacacuga

SEQ ID NO: 3202 - RNA, 19 nt, artificial sequence
  siRNA antisense sequence
ucagugucugcauuuggga

SEQ ID NO: 3203 - RNA, 19 nt, artificial sequence
  siRNA sense sequence
cccaaaugcagacacugau

SEQ ID NO: 3204 - RNA, 19 nt, artificial sequence
  siRNA antisense sequence
aucagugucugcauuuggg

SEQ ID NO: 3205 - RNA, 19 nt, artificial sequence
  siRNA sense sequence
caaaugcagacacugaugg

SEQ ID NO: 3206 - RNA, 19 nt, artificial sequence
  siRNA antisense sequence
ccaucagugucugcauuug

SEQ ID NO: 3207 - RNA, 19 nt, artificial sequence
  siRNA sense sequence
aaaugcagacacugauggg

SEQ ID NO: 3208 - RNA, 19 nt, artificial sequence
  siRNA antisense sequence
cccaucagugucugcauuu

SEQ ID NO: 3209 - RNA, 19 nt, artificial sequence
  siRNA sense sequence
aaugcagacacugaugggu

SEQ ID NO: 3210 - RNA, 19 nt, artificial sequence
  siRNA antisense sequence
acccaucagugucugcauu

SEQ ID NO: 3211 - RNA, 19 nt, artificial sequence
  siRNA sense sequence
augcagacacugaugggua

SEQ ID NO: 3212 - RNA, 19 nt, artificial sequence
  siRNA antisense sequence
uacccaucagugucugcau

SEQ ID NO: 3213 - RNA, 19 nt, artificial sequence
  siRNA sense sequence
ugcagacacugauggguaa

SEQ ID NO: 3214 - RNA, 19 nt, artificial sequence
  siRNA antisense sequence
uuacccaucagugucugca

SEQ ID NO: 3215 - RNA, 19 nt, artificial sequence
  siRNA sense sequence
gcagacacugauggguaau

SEQ ID NO: 3216 - RNA, 19 nt, artificial sequence
  siRNA antisense sequence
auuacccaucagugucugc

SEQ ID NO: 3217 - RNA, 19 nt, artificial sequence
  siRNA sense sequence
cagacacugauggguaauu

SEQ ID NO: 3218 - RNA, 19 nt, artificial sequence
  siRNA antisense sequence
aauuacccaucagugucug

SEQ ID NO: 3219 - RNA, 19 nt, artificial sequence
  siRNA sense sequence
agacacugauggguaauua

SEQ ID NO: 3220 - RNA, 19 nt, artificial sequence
  siRNA antisense sequence
uaauuacccaucagugucu

SEQ ID NO: 3221 - RNA, 19 nt, artificial sequence
  siRNA sense sequence
gacacugauggguaauuaa

SEQ ID NO: 3222 - RNA, 19 nt, artificial sequence
  siRNA antisense sequence
uuaauuacccaucaguguc

SEQ ID NO: 3223 - RNA, 19 nt, artificial sequence
  siRNA sense sequence
acacugauggguaauuaac

SEQ ID NO: 3224 - RNA, 19 nt, artificial sequence
  siRNA antisense sequence
guuaauuacccaucagugu

SEQ ID NO: 3225 - RNA, 19 nt, artificial sequence
  siRNA sense sequence
auaaaggcucagucucuaa

SEQ ID NO: 3226 - RNA, 19 nt, artificial sequence
  siRNA antisense sequence
uuagagacugagccuuuau

SEQ ID NO: 3227 - RNA, 19 nt, artificial sequence
  siRNA sense sequence
uaaaggcucagucucuaaa

SEQ ID NO: 3228 - RNA, 19 nt, artificial sequence
  siRNA antisense sequence
uuuagagacugagccuuua

SEQ ID NO: 3229 - RNA, 19 nt, artificial sequence
  siRNA sense sequence
cucaacucagauggagcca

SEQ ID NO: 3230 - RNA, 19 nt, artificial sequence
  siRNA antisense sequence
uggcuccaucugaguugag

SEQ ID NO: 3231 - RNA, 19 nt, artificial sequence
  siRNA sense sequence
ucaacucagauggagccac

SEQ ID NO: 3232 - RNA, 19 nt, artificial sequence
  siRNA antisense sequence
guggcuccaucugaguuga

SEQ ID NO: 3233 - RNA, 19 nt, artificial sequence
  siRNA sense sequence
caacucagauggagccacu

SEQ ID NO: 3234 - RNA, 19 nt, artificial sequence
  siRNA antisense sequence
aguggcuccaucugaguug

SEQ ID NO: 3235 - RNA, 19 nt, artificial sequence
  siRNA sense sequence
agauggagccacugggucu

SEQ ID NO: 3236 - RNA, 19 nt, artificial sequence
  siRNA antisense sequence
agacccaguggcuccaucu

SEQ ID NO: 3237 - RNA, 19 nt, artificial sequence
  siRNA sense sequence
gauggagccacugggucua

SEQ ID NO: 3238 - RNA, 19 nt, artificial sequence
  siRNA antisense sequence
uagacccaguggcuccauc

SEQ ID NO: 3239 - RNA, 19 nt, artificial sequence
  siRNA sense sequence
auggagccacugggucuaa

SEQ ID NO: 3240 - RNA, 19 nt, artificial sequence
  siRNA antisense sequence
uuagacccaguggcuccau

SEQ ID NO: 3241 - RNA, 19 nt, artificial sequence
  siRNA sense sequence
uggagccacugggucuaaa

SEQ ID NO: 3242 - RNA, 19 nt, artificial sequence
  siRNA antisense sequence
uuuagacccaguggcucca

SEQ ID NO: 3243 - RNA, 19 nt, artificial sequence
  siRNA sense sequence
ggagccacugggucuaaau

SEQ ID NO: 3244 - RNA, 19 nt, artificial sequence
  siRNA antisense sequence
auuuagacccaguggcucc

SEQ ID NO: 3245 - RNA, 19 nt, artificial sequence
  siRNA sense sequence
gagccacugggucuaaaug

SEQ ID NO: 3246 - RNA, 19 nt, artificial sequence
  siRNA antisense sequence
cauuuagacccaguggcuc

SEQ ID NO: 3247 - RNA, 19 nt, artificial sequence
  siRNA sense sequence
agccacugggucuaaaugc

SEQ ID NO: 3248 - RNA, 19 nt, artificial sequence
  siRNA antisense sequence
gcauuuagacccaguggcu

SEQ ID NO: 3249 - RNA, 19 nt, artificial sequence
  siRNA sense sequence
gccacugggucuaaaugcu

SEQ ID NO: 3250 - RNA, 19 nt, artificial sequence
  siRNA antisense sequence
agcauuuagacccaguggc

SEQ ID NO: 3251 - RNA, 19 nt, artificial sequence
  siRNA sense sequence
ccacugggucuaaaugcuc

SEQ ID NO: 3252 - RNA, 19 nt, artificial sequence
  siRNA antisense sequence
gagcauuuagacccagugg

SEQ ID NO: 3253 - RNA, 19 nt, artificial sequence
  siRNA sense sequence
cacugggucuaaaugcuca

SEQ ID NO: 3254 - RNA, 19 nt, artificial sequence
  siRNA antisense sequence
ugagcauuuagacccagug

SEQ ID NO: 3255 - RNA, 19 nt, artificial sequence
  siRNA sense sequence
acugggucuaaaugcucac

SEQ ID NO: 3256 - RNA, 19 nt, artificial sequence
  siRNA antisense sequence
gugagcauuuagacccagu

SEQ ID NO: 3257 - RNA, 19 nt, artificial sequence
  siRNA sense sequence
cugggucuaaaugcucacc

SEQ ID NO: 3258 - RNA, 19 nt, artificial sequence
  siRNA antisense sequence
ggugagcauuuagacccag

SEQ ID NO: 3259 - RNA, 19 nt, artificial sequence
  siRNA sense sequence
ggucuaaaugcucacccug

SEQ ID NO: 3260 - RNA, 19 nt, artificial sequence
  siRNA antisense sequence
cagggugagcauuuagacc

SEQ ID NO: 3261 - RNA, 19 nt, artificial sequence
  siRNA sense sequence
gucuaaaugcucacccugu

SEQ ID NO: 3262 - RNA, 19 nt, artificial sequence
  siRNA antisense sequence
acagggugagcauuuagac

SEQ ID NO: 3263 - RNA, 19 nt, artificial sequence
  siRNA sense sequence
ucuaaaugcucacccugug

SEQ ID NO: 3264 - RNA, 19 nt, artificial sequence
  siRNA antisense sequence
cacagggugagcauuuaga

SEQ ID NO: 3265 - RNA, 19 nt, artificial sequence
  siRNA sense sequence
cuaaaugcucacccugugg

SEQ ID NO: 3266 - RNA, 19 nt, artificial sequence
  siRNA antisense sequence
ccacagggugagcauuuag

SEQ ID NO: 3267 - RNA, 19 nt, artificial sequence
  siRNA sense sequence
gaugccaucuacgacugcu

SEQ ID NO: 3268 - RNA, 19 nt, artificial sequence
  siRNA antisense sequence
agcagucguagauggcauc

SEQ ID NO: 3269 - RNA, 19 nt, artificial sequence
  siRNA sense sequence
augccaucuacgacugcuc

SEQ ID NO: 3270 - RNA, 19 nt, artificial sequence
  siRNA antisense sequence
gagcagucguagauggcau

SEQ ID NO: 3271 - RNA, 19 nt, artificial sequence
  siRNA sense sequence
ugccaucuacgacugcucu

SEQ ID NO: 3272 - RNA, 19 nt, artificial sequence
  siRNA antisense sequence
agagcagucguagauggca

SEQ ID NO: 3273 - RNA, 19 nt, artificial sequence
  siRNA sense sequence
gccaucuacgacugcucuu

SEQ ID NO: 3274 - RNA, 19 nt, artificial sequence
  siRNA antisense sequence
aagagcagucguagauggc

SEQ ID NO: 3275 - RNA, 19 nt, artificial sequence
  siRNA sense sequence
ccaucuacgacugcucuuc

SEQ ID NO: 3276 - RNA, 19 nt, artificial sequence
  siRNA antisense sequence
gaagagcagucguagaugg

SEQ ID NO: 3277 - RNA, 19 nt, artificial sequence
  siRNA sense sequence
cuacgacugcucuucccuc

SEQ ID NO: 3278 - RNA, 19 nt, artificial sequence
  siRNA antisense sequence
gagggaagagcagucguag

SEQ ID NO: 3279 - RNA, 19 nt, artificial sequence
  siRNA sense sequence
uacgacugcucuucccucu

SEQ ID NO: 3280 - RNA, 19 nt, artificial sequence
  siRNA antisense sequence
agagggaagagcagucgua

SEQ ID NO: 3281 - RNA, 19 nt, artificial sequence
  siRNA sense sequence
aucucuggaguguauaagc

SEQ ID NO: 3282 - RNA, 19 nt, artificial sequence
  siRNA antisense sequence
gcuuauacacuccagagau

SEQ ID NO: 3283 - RNA, 19 nt, artificial sequence
  siRNA sense sequence
cuggaguguauaagcuucc

SEQ ID NO: 3284 - RNA, 19 nt, artificial sequence
  siRNA antisense sequence
ggaagcuuauacacuccag

SEQ ID NO: 3285 - RNA, 19 nt, artificial sequence
  siRNA sense sequence
uggaguguauaagcuuccu

SEQ ID NO: 3286 - RNA, 19 nt, artificial sequence
  siRNA antisense sequence
aggaagcuuauacacucca

SEQ ID NO: 3287 - RNA, 19 nt, artificial sequence
  siRNA sense sequence
ggaguguauaagcuuccuc

SEQ ID NO: 3288 - RNA, 19 nt, artificial sequence
  siRNA antisense sequence
gaggaagcuuauacacucc

SEQ ID NO: 3289 - RNA, 19 nt, artificial sequence
  siRNA sense sequence
guauaagcuuccuccugau

SEQ ID NO: 3290 - RNA, 19 nt, artificial sequence
  siRNA antisense sequence
aucaggaggaagcuuauac

SEQ ID NO: 3291 - RNA, 19 nt, artificial sequence
  siRNA sense sequence
uauaagcuuccuccugaug

SEQ ID NO: 3292 - RNA, 19 nt, artificial sequence
  siRNA antisense sequence
caucaggaggaagcuuaua

SEQ ID NO: 3293 - RNA, 19 nt, artificial sequence
  siRNA sense sequence
auaagcuuccuccugauga

SEQ ID NO: 3294 - RNA, 19 nt, artificial sequence
  siRNA antisense sequence
ucaucaggaggaagcuuau

SEQ ID NO: 3295 - RNA, 19 nt, artificial sequence
  siRNA sense sequence
aagcuuccuccugaugacu

SEQ ID NO: 3296 - RNA, 19 nt, artificial sequence
  siRNA antisense sequence
agucaucaggaggaagcuu

SEQ ID NO: 3297 - RNA, 19 nt, artificial sequence
  siRNA sense sequence
agcuuccuccugaugacuu

SEQ ID NO: 3298 - RNA, 19 nt, artificial sequence
  siRNA antisense sequence
aagucaucaggaggaagcu

SEQ ID NO: 3299 - RNA, 19 nt, artificial sequence
  siRNA sense sequence
gcuuccuccugaugacuuc

SEQ ID NO: 3300 - RNA, 19 nt, artificial sequence
  siRNA antisense sequence
gaagucaucaggaggaagc

SEQ ID NO: 3301 - RNA, 19 nt, artificial sequence
  siRNA sense sequence
cuuccuccugaugacuucc

SEQ ID NO: 3302 - RNA, 19 nt, artificial sequence
  siRNA antisense sequence
ggaagucaucaggaggaag

SEQ ID NO: 3303 - RNA, 19 nt, artificial sequence
  siRNA sense sequence
uuccuccugaugacuuccu

SEQ ID NO: 3304 - RNA, 19 nt, artificial sequence
  siRNA antisense sequence
aggaagucaucaggaggaa

SEQ ID NO: 3305 - RNA, 19 nt, artificial sequence
  siRNA sense sequence
acuuccugggcagcccuga

SEQ ID NO: 3306 - RNA, 19 nt, artificial sequence
  siRNA antisense sequence
ucagggcugcccaggaagu

SEQ ID NO: 3307 - RNA, 19 nt, artificial sequence
  siRNA sense sequence
acuggaggugaggucauua

SEQ ID NO: 3308 - RNA, 19 nt, artificial sequence
  siRNA antisense sequence
uaaugaccucaccuccagu

SEQ ID NO: 3309 - RNA, 19 nt, artificial sequence
  siRNA sense sequence
cuggaggugaggucauuac

SEQ ID NO: 3310 - RNA, 19 nt, artificial sequence
  siRNA antisense sequence
guaaugaccucaccuccag

SEQ ID NO: 3311 - RNA, 19 nt, artificial sequence
  siRNA sense sequence
uggaggugaggucauuaca

SEQ ID NO: 3312 - RNA, 19 nt, artificial sequence
  siRNA antisense sequence
uguaaugaccucaccucca

SEQ ID NO: 3313 - RNA, 19 nt, artificial sequence
  siRNA sense sequence
ggaggugaggucauuacag

SEQ ID NO: 3314 - RNA, 19 nt, artificial sequence
  siRNA antisense sequence
cuguaaugaccucaccucc

SEQ ID NO: 3315 - RNA, 19 nt, artificial sequence
  siRNA sense sequence
gaggugaggucauuacagu

SEQ ID NO: 3316 - RNA, 19 nt, artificial sequence
  siRNA antisense sequence
acuguaaugaccucaccuc

SEQ ID NO: 3317 - RNA, 19 nt, artificial sequence
  siRNA sense sequence
aggugaggucauuacaguc

SEQ ID NO: 3318 - RNA, 19 nt, artificial sequence
  siRNA antisense sequence
gacuguaaugaccucaccu

SEQ ID NO: 3319 - RNA, 19 nt, artificial sequence
  siRNA sense sequence
ggugaggucauuacaguca

SEQ ID NO: 3320 - RNA, 19 nt, artificial sequence
  siRNA antisense sequence
ugacuguaaugaccucacc

SEQ ID NO: 3321 - RNA, 19 nt, artificial sequence
  siRNA sense sequence
ucauuacagucacuggcca

SEQ ID NO: 3322 - RNA, 19 nt, artificial sequence
  siRNA antisense sequence
uggccagugacuguaauga

SEQ ID NO: 3323 - RNA, 19 nt, artificial sequence
  siRNA sense sequence
cauuacagucacuggccau

SEQ ID NO: 3324 - RNA, 19 nt, artificial sequence
  siRNA antisense sequence
auggccagugacuguaaug

SEQ ID NO: 3325 - RNA, 19 nt, artificial sequence
  siRNA sense sequence
auuacagucacuggccaug

SEQ ID NO: 3326 - RNA, 19 nt, artificial sequence
  siRNA antisense sequence
cauggccagugacuguaau

SEQ ID NO: 3327 - RNA, 19 nt, artificial sequence
  siRNA sense sequence
uacagucacuggccaugcc

SEQ ID NO: 3328 - RNA, 19 nt, artificial sequence
  siRNA antisense sequence
ggcauggccagugacugua

SEQ ID NO: 3329 - RNA, 19 nt, artificial sequence
  siRNA sense sequence
acagucacuggccaugccc

SEQ ID NO: 3330 - RNA, 19 nt, artificial sequence
  siRNA antisense sequence
gggcauggccagugacugu

SEQ ID NO: 3331 - RNA, 19 nt, artificial sequence
  siRNA sense sequence
cagucacuggccaugcccu

SEQ ID NO: 3332 - RNA, 19 nt, artificial sequence
  siRNA antisense sequence
agggcauggccagugacug

SEQ ID NO: 3333 - RNA, 19 nt, artificial sequence
  siRNA sense sequence
gucacuggccaugcccuaa

SEQ ID NO: 3334 - RNA, 19 nt, artificial sequence
  siRNA antisense sequence
uuagggcauggccagugac

SEQ ID NO: 3335 - RNA, 19 nt, artificial sequence
  siRNA sense sequence
ucacuggccaugcccuaau

SEQ ID NO: 3336 - RNA, 19 nt, artificial sequence
  siRNA antisense sequence
auuagggcauggccaguga

SEQ ID NO: 3337 - RNA, 19 nt, artificial sequence
  siRNA sense sequence
cacuggccaugcccuaaua

SEQ ID NO: 3338 - RNA, 19 nt, artificial sequence
  siRNA antisense sequence
uauuagggcauggccagug

SEQ ID NO: 3339 - RNA, 19 nt, artificial sequence
  siRNA sense sequence
acuggccaugcccuaauac

SEQ ID NO: 3340 - RNA, 19 nt, artificial sequence
  siRNA antisense sequence
guauuagggcauggccagu

SEQ ID NO: 3341 - RNA, 19 nt, artificial sequence
  siRNA sense sequence
cuggccaugcccuaauacc

SEQ ID NO: 3342 - RNA, 19 nt, artificial sequence
  siRNA antisense sequence
gguauuagggcauggccag

SEQ ID NO: 3343 - RNA, 19 nt, artificial sequence
  siRNA sense sequence
uggccaugcccuaauaccu

SEQ ID NO: 3344 - RNA, 19 nt, artificial sequence
  siRNA antisense sequence
agguauuagggcauggcca

SEQ ID NO: 3345 - RNA, 19 nt, artificial sequence
  siRNA sense sequence
gccaugcccuaauaccugu

SEQ ID NO: 3346 - RNA, 19 nt, artificial sequence
  siRNA antisense sequence
acagguauuagggcauggc

SEQ ID NO: 3347 - RNA, 19 nt, artificial sequence
  siRNA sense sequence
ccaugcccuaauaccuguc

SEQ ID NO: 3348 - RNA, 19 nt, artificial sequence
  siRNA antisense sequence
gacagguauuagggcaugg

SEQ ID NO: 3349 - RNA, 19 nt, artificial sequence
  siRNA sense sequence
caugcccuaauaccugucc

SEQ ID NO: 3350 - RNA, 19 nt, artificial sequence
  siRNA antisense sequence
ggacagguauuagggcaug

SEQ ID NO: 3351 - RNA, 19 nt, artificial sequence
  siRNA sense sequence
augcccuaauaccuguccu

SEQ ID NO: 3352 - RNA, 19 nt, artificial sequence
  siRNA antisense sequence
aggacagguauuagggcau

SEQ ID NO: 3353 - RNA, 19 nt, artificial sequence
  siRNA sense sequence
ugcccuaauaccuguccuu

SEQ ID NO: 3354 - RNA, 19 nt, artificial sequence
  siRNA antisense sequence
aaggacagguauuagggca

SEQ ID NO: 3355 - RNA, 19 nt, artificial sequence
  siRNA sense sequence
gcccuaauaccuguccuuc

SEQ ID NO: 3356 - RNA, 19 nt, artificial sequence
  siRNA antisense sequence
gaaggacagguauuagggc

SEQ ID NO: 3357 - RNA, 19 nt, artificial sequence
  siRNA sense sequence
cccuaauaccuguccuuca

SEQ ID NO: 3358 - RNA, 19 nt, artificial sequence
  siRNA antisense sequence
ugaaggacagguauuaggg

SEQ ID NO: 3359 - RNA, 19 nt, artificial sequence
  siRNA sense sequence
cuaauaccuguccuucacc

SEQ ID NO: 3360 - RNA, 19 nt, artificial sequence
  siRNA antisense sequence
ggugaaggacagguauuag

SEQ ID NO: 3361 - RNA, 19 nt, artificial sequence
  siRNA sense sequence
uaauaccuguccuucaccc

SEQ ID NO: 3362 - RNA, 19 nt, artificial sequence
  siRNA antisense sequence
gggugaaggacagguauua

SEQ ID NO: 3363 - RNA, 19 nt, artificial sequence
  siRNA sense sequence
acagggccauucacaguuu

SEQ ID NO: 3364 - RNA, 19 nt, artificial sequence
  siRNA antisense sequence
aaacugugaauggcccugu

SEQ ID NO: 3365 - RNA, 19 nt, artificial sequence
  siRNA sense sequence
cagggccauucacaguuua

SEQ ID NO: 3366 - RNA, 19 nt, artificial sequence
  siRNA antisense sequence
uaaacugugaauggcccug

SEQ ID NO: 3367 - RNA, 19 nt, artificial sequence
  siRNA sense sequence
agggccauucacaguuuaa

SEQ ID NO: 3368 - RNA, 19 nt, artificial sequence
  siRNA antisense sequence
uuaaacugugaauggcccu

SEQ ID NO: 3369 - RNA, 19 nt, artificial sequence
  siRNA sense sequence
gggccauucacaguuuaaa

SEQ ID NO: 3370 - RNA, 19 nt, artificial sequence
  siRNA antisense sequence
uuuaaacugugaauggccc

SEQ ID NO: 3371 - RNA, 19 nt, artificial sequence
  siRNA sense sequence
ggccauucacaguuuaaag

SEQ ID NO: 3372 - RNA, 19 nt, artificial sequence
  siRNA antisense sequence
cuuuaaacugugaauggcc

SEQ ID NO: 3373 - RNA, 19 nt, artificial sequence
  siRNA sense sequence
ccauucacaguuuaaagaa

SEQ ID NO: 3374 - RNA, 19 nt, artificial sequence
  siRNA antisense sequence
uucuuuaaacugugaaugg

SEQ ID NO: 3375 - RNA, 19 nt, artificial sequence
  siRNA sense sequence
cuguaaucccagcacuaug

SEQ ID NO: 3376 - RNA, 19 nt, artificial sequence
  siRNA antisense sequence
cauagugcugggauuacag

SEQ ID NO: 3377 - RNA, 19 nt, artificial sequence
  siRNA sense sequence
uguaaucccagcacuaugg

SEQ ID NO: 3378 - RNA, 19 nt, artificial sequence
  siRNA antisense sequence
ccauagugcugggauuaca

SEQ ID NO: 3379 - RNA, 19 nt, artificial sequence
  siRNA sense sequence
acuaugggaggccgaggca

SEQ ID NO: 3380 - RNA, 19 nt, artificial sequence
  siRNA antisense sequence
ugccucggccucccauagu

SEQ ID NO: 3381 - RNA, 19 nt, artificial sequence
  siRNA sense sequence
ccgaggcagguggaucacu

SEQ ID NO: 3382 - RNA, 19 nt, artificial sequence
  siRNA antisense sequence
agugauccaccugccucgg

SEQ ID NO: 3383 - RNA, 19 nt, artificial sequence
  siRNA sense sequence
cgaggcagguggaucacuu

SEQ ID NO: 3384 - RNA, 19 nt, artificial sequence
  siRNA antisense sequence
aagugauccaccugccucg

SEQ ID NO: 3385 - RNA, 19 nt, artificial sequence
  siRNA sense sequence
gaggcagguggaucacuuc

SEQ ID NO: 3386 - RNA, 19 nt, artificial sequence
  siRNA antisense sequence
gaagugauccaccugccuc

SEQ ID NO: 3387 - RNA, 19 nt, artificial sequence
  siRNA sense sequence
aggcagguggaucacuuca

SEQ ID NO: 3388 - RNA, 19 nt, artificial sequence
  siRNA antisense sequence
ugaagugauccaccugccu

SEQ ID NO: 3389 - RNA, 19 nt, artificial sequence
  siRNA sense sequence
ggcagguggaucacuucag

SEQ ID NO: 3390 - RNA, 19 nt, artificial sequence
  siRNA antisense sequence
cugaagugauccaccugcc

SEQ ID NO: 3391 - RNA, 19 nt, artificial sequence
  siRNA sense sequence
gcagguggaucacuucagg

SEQ ID NO: 3392 - RNA, 19 nt, artificial sequence
  siRNA antisense sequence
ccugaagugauccaccugc

SEQ ID NO: 3393 - RNA, 19 nt, artificial sequence
  siRNA sense sequence
cagguggaucacuucaggu

SEQ ID NO: 3394 - RNA, 19 nt, artificial sequence
  siRNA antisense sequence
accugaagugauccaccug

SEQ ID NO: 3395 - RNA, 19 nt, artificial sequence
  siRNA sense sequence
guuuaagaccagccuggcc

SEQ ID NO: 3396 - RNA, 19 nt, artificial sequence
  siRNA antisense sequence
ggccaggcuggucuuaaac

SEQ ID NO: 3397 - RNA, 19 nt, artificial sequence
  siRNA sense sequence
uuuaagaccagccuggcca

SEQ ID NO: 3398 - RNA, 19 nt, artificial sequence
  siRNA antisense sequence
uggccaggcuggucuuaaa

SEQ ID NO: 3399 - RNA, 19 nt, artificial sequence
  siRNA sense sequence
uuaagaccagccuggccaa

SEQ ID NO: 3400 - RNA, 19 nt, artificial sequence
  siRNA antisense sequence
uuggccaggcuggucuuaa

SEQ ID NO: 3401 - RNA, 19 nt, artificial sequence
  siRNA sense sequence
uaagaccagccuggccaac

SEQ ID NO: 3402 - RNA, 19 nt, artificial sequence
  siRNA antisense sequence
guuggccaggcuggucuua

SEQ ID NO: 3403 - RNA, 19 nt, artificial sequence
  siRNA sense sequence
aaaauuagccaggcauggu

SEQ ID NO: 3404 - RNA, 19 nt, artificial sequence
  siRNA antisense sequence
accaugccuggcuaauuuu

SEQ ID NO: 3405 - RNA, 19 nt, artificial sequence
  siRNA sense sequence
aaauuagccaggcauggug

SEQ ID NO: 3406 - RNA, 19 nt, artificial sequence
  siRNA antisense sequence
caccaugccuggcuaauuu

SEQ ID NO: 3407 - RNA, 19 nt, artificial sequence
  siRNA sense sequence
aauuagccaggcauggugg

SEQ ID NO: 3408 - RNA, 19 nt, artificial sequence
  siRNA antisense sequence
ccaccaugccuggcuaauu

SEQ ID NO: 3409 - RNA, 19 nt, artificial sequence
  siRNA sense sequence
auuagccaggcaugguggu

SEQ ID NO: 3410 - RNA, 19 nt, artificial sequence
  siRNA antisense sequence
accaccaugccuggcuaau

SEQ ID NO: 3411 - RNA, 19 nt, artificial sequence
  siRNA sense sequence
uuagccaggcaugguggug

SEQ ID NO: 3412 - RNA, 19 nt, artificial sequence
  siRNA antisense sequence
caccaccaugccuggcuaa

SEQ ID NO: 3413 - RNA, 19 nt, artificial sequence
  siRNA sense sequence
uagccaggcaugguggugg

SEQ ID NO: 3414 - RNA, 19 nt, artificial sequence
  siRNA antisense sequence
ccaccaccaugccuggcua

SEQ ID NO: 3415 - RNA, 19 nt, artificial sequence
  siRNA sense sequence
aacucaggaggcagagguu

SEQ ID NO: 3416 - RNA, 19 nt, artificial sequence
  siRNA antisense sequence
aaccucugccuccugaguu

SEQ ID NO: 3417 - RNA, 19 nt, artificial sequence
  siRNA sense sequence
acucaggaggcagagguug

SEQ ID NO: 3418 - RNA, 19 nt, artificial sequence
  siRNA antisense sequence
caaccucugccuccugagu

SEQ ID NO: 3419 - RNA, 19 nt, artificial sequence
  siRNA sense sequence
cucaggaggcagagguugc

SEQ ID NO: 3420 - RNA, 19 nt, artificial sequence
  siRNA antisense sequence
gcaaccucugccuccugag

SEQ ID NO: 3421 - RNA, 19 nt, artificial sequence
  siRNA sense sequence
ucaggaggcagagguugca

SEQ ID NO: 3422 - RNA, 19 nt, artificial sequence
  siRNA antisense sequence
ugcaaccucugccuccuga

SEQ ID NO: 3423 - RNA, 19 nt, artificial sequence
  siRNA sense sequence
caggaggcagagguugcag

SEQ ID NO: 3424 - RNA, 19 nt, artificial sequence
  siRNA antisense sequence
cugcaaccucugccuccug

SEQ ID NO: 3425 - RNA, 19 nt, artificial sequence
  siRNA sense sequence
gagguugcagugagccgag

SEQ ID NO: 3426 - RNA, 19 nt, artificial sequence
  siRNA antisense sequence
cucggcucacugcaaccuc

SEQ ID NO: 3427 - RNA, 19 nt, artificial sequence
  siRNA sense sequence
aucacgccacugcacuaua

SEQ ID NO: 3428 - RNA, 19 nt, artificial sequence
  siRNA antisense sequence
uauagugcaguggcgugau

SEQ ID NO: 3429 - RNA, 19 nt, artificial sequence
  siRNA sense sequence
ucacgccacugcacuauaa

SEQ ID NO: 3430 - RNA, 19 nt, artificial sequence
  siRNA antisense sequence
uuauagugcaguggcguga

SEQ ID NO: 3431 - RNA, 19 nt, artificial sequence
  siRNA sense sequence
cacgccacugcacuauaau

SEQ ID NO: 3432 - RNA, 19 nt, artificial sequence
  siRNA antisense sequence
auuauagugcaguggcgug

SEQ ID NO: 3433 - RNA, 19 nt, artificial sequence
  siRNA sense sequence
acgccacugcacuauaauc

SEQ ID NO: 3434 - RNA, 19 nt, artificial sequence
  siRNA antisense sequence
gauuauagugcaguggcgu

SEQ ID NO: 3435 - RNA, 19 nt, artificial sequence
  siRNA sense sequence
cgccacugcacuauaaucu

SEQ ID NO: 3436 - RNA, 19 nt, artificial sequence
  siRNA antisense sequence
agauuauagugcaguggcg

SEQ ID NO: 3437 - RNA, 19 nt, artificial sequence
  siRNA sense sequence
gccacugcacuauaaucug

SEQ ID NO: 3438 - RNA, 19 nt, artificial sequence
  siRNA antisense sequence
cagauuauagugcaguggc

SEQ ID NO: 3439 - RNA, 19 nt, artificial sequence
  siRNA sense sequence
acccaggcaucuguuuggc

SEQ ID NO: 3440 - RNA, 19 nt, artificial sequence
  siRNA antisense sequence
gccaaacagaugccugggu

SEQ ID NO: 3441 - RNA, 19 nt, artificial sequence
  siRNA sense sequence
cccaggcaucuguuuggcc

SEQ ID NO: 3442 - RNA, 19 nt, artificial sequence
  siRNA antisense sequence
ggccaaacagaugccuggg

SEQ ID NO: 3443 - RNA, 19 nt, artificial sequence
  siRNA sense sequence
ccaggcaucuguuuggccc

SEQ ID NO: 3444 - RNA, 19 nt, artificial sequence
  siRNA antisense sequence
gggccaaacagaugccugg

SEQ ID NO: 3445 - RNA, 19 nt, artificial sequence
  siRNA sense sequence
cccuucaaaucauuaucag

SEQ ID NO: 3446 - RNA, 19 nt, artificial sequence
  siRNA antisense sequence
cugauaaugauuugaaggg

SEQ ID NO: 3447 - RNA, 19 nt, artificial sequence
  siRNA sense sequence
ccuucaaaucauuaucagu

SEQ ID NO: 3448 - RNA, 19 nt, artificial sequence
  siRNA antisense sequence
acugauaaugauuugaagg

SEQ ID NO: 3449 - RNA, 19 nt, artificial sequence
  siRNA sense sequence
cuucaaaucauuaucaguc

SEQ ID NO: 3450 - RNA, 19 nt, artificial sequence
  siRNA antisense sequence
gacugauaaugauuugaag

SEQ ID NO: 3451 - RNA, 19 nt, artificial sequence
  siRNA sense sequence
acauagaucagaucauucu

SEQ ID NO: 3452 - RNA, 19 nt, artificial sequence
  siRNA antisense sequence
agaaugaucugaucuaugu

SEQ ID NO: 3453 - RNA, 19 nt, artificial sequence
  siRNA sense sequence
cauagaucagaucauucuu

SEQ ID NO: 3454 - RNA, 19 nt, artificial sequence
  siRNA antisense sequence
aagaaugaucugaucuaug

SEQ ID NO: 3455 - RNA, 19 nt, artificial sequence
  siRNA sense sequence
ucagaucauucuuauaacc

SEQ ID NO: 3456 - RNA, 19 nt, artificial sequence
  siRNA antisense sequence
gguuauaagaaugaucuga

SEQ ID NO: 3457 - RNA, 19 nt, artificial sequence
  siRNA sense sequence
cagaucauucuuauaacca

SEQ ID NO: 3458 - RNA, 19 nt, artificial sequence
  siRNA antisense sequence
ugguuauaagaaugaucug

SEQ ID NO: 3459 - RNA, 19 nt, artificial sequence
  siRNA sense sequence
auaaccaccacauaacuua

SEQ ID NO: 3460 - RNA, 19 nt, artificial sequence
  siRNA antisense sequence
uaaguuauguggugguuau

SEQ ID NO: 3461 - RNA, 19 nt, artificial sequence
  siRNA sense sequence
uaaccaccacauaacuuag

SEQ ID NO: 3462 - RNA, 19 nt, artificial sequence
  siRNA antisense sequence
cuaaguuauguggugguua

SEQ ID NO: 3463 - RNA, 19 nt, artificial sequence
  siRNA sense sequence
aaccaccacauaacuuagu

SEQ ID NO: 3464 - RNA, 19 nt, artificial sequence
  siRNA antisense sequence
acuaaguuauguggugguu

SEQ ID NO: 3465 - RNA, 19 nt, artificial sequence
  siRNA sense sequence
accaccacauaacuuaguu

SEQ ID NO: 3466 - RNA, 19 nt, artificial sequence
  siRNA antisense sequence
aacuaaguuaugugguggu

SEQ ID NO: 3467 - RNA, 19 nt, artificial sequence
  siRNA sense sequence
ccaccacauaacuuaguuu

SEQ ID NO: 3468 - RNA, 19 nt, artificial sequence
  siRNA antisense sequence
aaacuaaguuauguggugg

SEQ ID NO: 3469 - RNA, 19 nt, artificial sequence
  siRNA sense sequence
caccacauaacuuaguuua

SEQ ID NO: 3470 - RNA, 19 nt, artificial sequence
  siRNA antisense sequence
uaaacuaaguuauguggug

SEQ ID NO: 3471 - RNA, 19 nt, artificial sequence
  siRNA sense sequence
acacgaaggcagcaucaaa

SEQ ID NO: 3472 - RNA, 19 nt, artificial sequence
  siRNA antisense sequence
uuugaugcugccuucgugu

SEQ ID NO: 3473 - RNA, 19 nt, artificial sequence
  siRNA sense sequence
cacgaaggcagcaucaaau

SEQ ID NO: 3474 - RNA, 19 nt, artificial sequence
  siRNA antisense sequence
auuugaugcugccuucgug

SEQ ID NO: 3475 - RNA, 19 nt, artificial sequence
  siRNA sense sequence
acgaaggcagcaucaaauu

SEQ ID NO: 3476 - RNA, 19 nt, artificial sequence
  siRNA antisense sequence
aauuugaugcugccuucgu

SEQ ID NO: 3477 - RNA, 19 nt, artificial sequence
  siRNA sense sequence
cgaaggcagcaucaaauua

SEQ ID NO: 3478 - RNA, 19 nt, artificial sequence
  siRNA antisense sequence
uaauuugaugcugccuucg

SEQ ID NO: 3479 - RNA, 19 nt, artificial sequence
  siRNA sense sequence
gaaggcagcaucaaauuau

SEQ ID NO: 3480 - RNA, 19 nt, artificial sequence
  siRNA antisense sequence
auaauuugaugcugccuuc

SEQ ID NO: 3481 - RNA, 19 nt, artificial sequence
  siRNA sense sequence
aaggcagcaucaaauuauc

SEQ ID NO: 3482 - RNA, 19 nt, artificial sequence
  siRNA antisense sequence
gauaauuugaugcugccuu

SEQ ID NO: 3483 - RNA, 19 nt, artificial sequence
  siRNA sense sequence
aggcagcaucaaauuaucu

SEQ ID NO: 3484 - RNA, 19 nt, artificial sequence
  siRNA antisense sequence
agauaauuugaugcugccu

SEQ ID NO: 3485 - RNA, 19 nt, artificial sequence
  siRNA sense sequence
ggcagcaucaaauuaucug

SEQ ID NO: 3486 - RNA, 19 nt, artificial sequence
  siRNA antisense sequence
cagauaauuugaugcugcc

SEQ ID NO: 3487 - RNA, 19 nt, artificial sequence
  siRNA sense sequence
aauuaucuggauuuucacc

SEQ ID NO: 3488 - RNA, 19 nt, artificial sequence
  siRNA antisense sequence
ggugaaaauccagauaauu

SEQ ID NO: 3489 - RNA, 19 nt, artificial sequence
  siRNA sense sequence
auuaucuggauuuucaccc

SEQ ID NO: 3490 - RNA, 19 nt, artificial sequence
  siRNA antisense sequence
gggugaaaauccagauaau

SEQ ID NO: 3491 - RNA, 19 nt, artificial sequence
  siRNA sense sequence
uuaucuggauuuucaccca

SEQ ID NO: 3492 - RNA, 19 nt, artificial sequence
  siRNA antisense sequence
ugggugaaaauccagauaa

SEQ ID NO: 3493 - RNA, 19 nt, artificial sequence
  siRNA sense sequence
auuuucacccaggcauggu

SEQ ID NO: 3494 - RNA, 19 nt, artificial sequence
  siRNA antisense sequence
accaugccugggugaaaau

SEQ ID NO: 3495 - RNA, 19 nt, artificial sequence
  siRNA sense sequence
acccaggcaugguggcuca

SEQ ID NO: 3496 - RNA, 19 nt, artificial sequence
  siRNA antisense sequence
ugagccaccaugccugggu

SEQ ID NO: 3497 - RNA, 19 nt, artificial sequence
  siRNA sense sequence
ccaggcaugguggcucaca

SEQ ID NO: 3498 - RNA, 19 nt, artificial sequence
  siRNA antisense sequence
ugugagccaccaugccugg

SEQ ID NO: 3499 - RNA, 19 nt, artificial sequence
  siRNA sense sequence
caggcaugguggcucacac

SEQ ID NO: 3500 - RNA, 19 nt, artificial sequence
  siRNA antisense sequence
gugugagccaccaugccug

SEQ ID NO: 3501 - RNA, 19 nt, artificial sequence
  siRNA sense sequence
guggcucacaccuguaauc

SEQ ID NO: 3502 - RNA, 19 nt, artificial sequence
  siRNA antisense sequence
gauuacaggugugagccac

SEQ ID NO: 3503 - RNA, 19 nt, artificial sequence
  siRNA sense sequence
uggcucacaccuguaaucc

SEQ ID NO: 3504 - RNA, 19 nt, artificial sequence
  siRNA antisense sequence
ggauuacaggugugagcca

SEQ ID NO: 3505 - RNA, 19 nt, artificial sequence
  siRNA sense sequence
ggcucacaccuguaauccc

SEQ ID NO: 3506 - RNA, 19 nt, artificial sequence
  siRNA antisense sequence
gggauuacaggugugagcc

SEQ ID NO: 3507 - RNA, 19 nt, artificial sequence
  siRNA sense sequence
cacaccuguaaucccaagu

SEQ ID NO: 3508 - RNA, 19 nt, artificial sequence
  siRNA antisense sequence
acuugggauuacaggugug

SEQ ID NO: 3509 - RNA, 19 nt, artificial sequence
  siRNA sense sequence
acaccuguaaucccaaguu

SEQ ID NO: 3510 - RNA, 19 nt, artificial sequence
  siRNA antisense sequence
aacuugggauuacaggugu

SEQ ID NO: 3511 - RNA, 19 nt, artificial sequence
  siRNA sense sequence
caccuguaaucccaaguuu

SEQ ID NO: 3512 - RNA, 19 nt, artificial sequence
  siRNA antisense sequence
aaacuugggauuacaggug

SEQ ID NO: 3513 - RNA, 19 nt, artificial sequence
  siRNA sense sequence
accuguaaucccaaguuuu

SEQ ID NO: 3514 - RNA, 19 nt, artificial sequence
  siRNA antisense sequence
aaaacuugggauuacaggu

SEQ ID NO: 3515 - RNA, 19 nt, artificial sequence
  siRNA sense sequence
ggcacucuggucccagcua

SEQ ID NO: 3516 - RNA, 19 nt, artificial sequence
  siRNA antisense sequence
uagcugggaccagagugcc

SEQ ID NO: 3517 - RNA, 19 nt, artificial sequence
  siRNA sense sequence
gcacucuggucccagcuac

SEQ ID NO: 3518 - RNA, 19 nt, artificial sequence
  siRNA antisense sequence
guagcugggaccagagugc

SEQ ID NO: 3519 - RNA, 19 nt, artificial sequence
  siRNA sense sequence
cacucuggucccagcuacu

SEQ ID NO: 3520 - RNA, 19 nt, artificial sequence
  siRNA antisense sequence
aguagcugggaccagagug

SEQ ID NO: 3521 - RNA, 19 nt, artificial sequence
  siRNA sense sequence
acucuggucccagcuacua

SEQ ID NO: 3522 - RNA, 19 nt, artificial sequence
  siRNA antisense sequence
uaguagcugggaccagagu

SEQ ID NO: 3523 - RNA, 19 nt, artificial sequence
  siRNA sense sequence
aacucaggagguggagguu

SEQ ID NO: 3524 - RNA, 19 nt, artificial sequence
  siRNA antisense sequence
aaccuccaccuccugaguu

SEQ ID NO: 3525 - RNA, 19 nt, artificial sequence
  siRNA sense sequence
acucaggagguggagguug

SEQ ID NO: 3526 - RNA, 19 nt, artificial sequence
  siRNA antisense sequence
caaccuccaccuccugagu

SEQ ID NO: 3527 - RNA, 19 nt, artificial sequence
  siRNA sense sequence
cucaggagguggagguugc

SEQ ID NO: 3528 - RNA, 19 nt, artificial sequence
  siRNA antisense sequence
gcaaccuccaccuccugag

SEQ ID NO: 3529 - RNA, 19 nt, artificial sequence
  siRNA sense sequence
ucaggagguggagguugca

SEQ ID NO: 3530 - RNA, 19 nt, artificial sequence
  siRNA antisense sequence
ugcaaccuccaccuccuga

SEQ ID NO: 3531 - RNA, 19 nt, artificial sequence
  siRNA sense sequence
caggagguggagguugcag

SEQ ID NO: 3532 - RNA, 19 nt, artificial sequence
  siRNA antisense sequence
cugcaaccuccaccuccug

SEQ ID NO: 3533 - RNA, 19 nt, artificial sequence
  siRNA sense sequence
gagguugcagugagccgag

SEQ ID NO: 3534 - RNA, 19 nt, artificial sequence
  siRNA antisense sequence
cucggcucacugcaaccuc

SEQ ID NO: 3535 - RNA, 19 nt, artificial sequence
  siRNA sense sequence
agauugcaccacuguacuc

SEQ ID NO: 3536 - RNA, 19 nt, artificial sequence
  siRNA antisense sequence
gaguacaguggugcaaucu

SEQ ID NO: 3537 - RNA, 19 nt, artificial sequence
  siRNA sense sequence
acuguacucuagccugggc

SEQ ID NO: 3538 - RNA, 19 nt, artificial sequence
  siRNA antisense sequence
gcccaggcuagaguacagu

SEQ ID NO: 3539 - RNA, 19 nt, artificial sequence
  siRNA sense sequence
cuguacucuagccugggca

SEQ ID NO: 3540 - RNA, 19 nt, artificial sequence
  siRNA antisense sequence
ugcccaggcuagaguacag

SEQ ID NO: 3541 - RNA, 19 nt, artificial sequence
  siRNA sense sequence
uguacucuagccugggcaa

SEQ ID NO: 3542 - RNA, 19 nt, artificial sequence
  siRNA antisense sequence
uugcccaggcuagaguaca

SEQ ID NO: 3543 - RNA, 19 nt, artificial sequence
  siRNA sense sequence
ucccuccaagcuucaugug

SEQ ID NO: 3544 - RNA, 19 nt, artificial sequence
  siRNA antisense sequence
cacaugaagcuuggaggga

SEQ ID NO: 3545 - RNA, 19 nt, artificial sequence
  siRNA sense sequence
cccuccaagcuucaugugc

SEQ ID NO: 3546 - RNA, 19 nt, artificial sequence
  siRNA antisense sequence
gcacaugaagcuuggaggg

SEQ ID NO: 3547 - RNA, 19 nt, artificial sequence
  siRNA sense sequence
ccuccaagcuucaugugca

SEQ ID NO: 3548 - RNA, 19 nt, artificial sequence
  siRNA antisense sequence
ugcacaugaagcuuggagg

SEQ ID NO: 3549 - RNA, 19 nt, artificial sequence
  siRNA sense sequence
cuccaagcuucaugugcac

SEQ ID NO: 3550 - RNA, 19 nt, artificial sequence
  siRNA antisense sequence
gugcacaugaagcuuggag

SEQ ID NO: 3551 - RNA, 19 nt, artificial sequence
  siRNA sense sequence
ggcccaauuugcaucguuc

SEQ ID NO: 3552 - RNA, 19 nt, artificial sequence
  siRNA antisense sequence
gaacgaugcaaauugggcc

SEQ ID NO: 3553 - RNA, 19 nt, artificial sequence
  siRNA sense sequence
gcccaauuugcaucguucu

SEQ ID NO: 3554 - RNA, 19 nt, artificial sequence
  siRNA antisense sequence
agaacgaugcaaauugggc

SEQ ID NO: 3555 - RNA, 19 nt, artificial sequence
  siRNA sense sequence
cccaauuugcaucguucuu

SEQ ID NO: 3556 - RNA, 19 nt, artificial sequence
  siRNA antisense sequence
aagaacgaugcaaauuggg

SEQ ID NO: 3557 - RNA, 19 nt, artificial sequence
  siRNA sense sequence
ccaauuugcaucguucuuc

SEQ ID NO: 3558 - RNA, 19 nt, artificial sequence
  siRNA antisense sequence
gaagaacgaugcaaauugg

SEQ ID NO: 3559 - RNA, 19 nt, artificial sequence
  siRNA sense sequence
uuugcaucguucuuccaga

SEQ ID NO: 3560 - RNA, 19 nt, artificial sequence
  siRNA antisense sequence
ucuggaagaacgaugcaaa

SEQ ID NO: 3561 - RNA, 19 nt, artificial sequence
  siRNA sense sequence
caucguucuuccagagcaa

SEQ ID NO: 3562 - RNA, 19 nt, artificial sequence
  siRNA antisense sequence
uugcucuggaagaacgaug

SEQ ID NO: 3563 - RNA, 19 nt, artificial sequence
  siRNA sense sequence
aucguucuuccagagcaau

SEQ ID NO: 3564 - RNA, 19 nt, artificial sequence
  siRNA antisense sequence
auugcucuggaagaacgau

SEQ ID NO: 3565 - RNA, 19 nt, artificial sequence
  siRNA sense sequence
ucguucuuccagagcaaug

SEQ ID NO: 3566 - RNA, 19 nt, artificial sequence
  siRNA antisense sequence
cauugcucuggaagaacga

SEQ ID NO: 3567 - RNA, 19 nt, artificial sequence
  siRNA sense sequence
cguucuuccagagcaaugc

SEQ ID NO: 3568 - RNA, 19 nt, artificial sequence
  siRNA antisense sequence
gcauugcucuggaagaacg

SEQ ID NO: 3569 - RNA, 19 nt, artificial sequence
  siRNA sense sequence
cuuccagagcaaugcacca

SEQ ID NO: 3570 - RNA, 19 nt, artificial sequence
  siRNA antisense sequence
uggugcauugcucuggaag

SEQ ID NO: 3571 - RNA, 19 nt, artificial sequence
  siRNA sense sequence
uuccagagcaaugcaccac

SEQ ID NO: 3572 - RNA, 19 nt, artificial sequence
  siRNA antisense sequence
guggugcauugcucuggaa

SEQ ID NO: 3573 - RNA, 19 nt, artificial sequence
  siRNA sense sequence
cccgagugagccaguguga

SEQ ID NO: 3574 - RNA, 19 nt, artificial sequence
  siRNA antisense sequence
ucacacuggcucacucggg

SEQ ID NO: 3575 - RNA, 19 nt, artificial sequence
  siRNA sense sequence
ccgagugagccagugugac

SEQ ID NO: 3576 - RNA, 19 nt, artificial sequence
  siRNA antisense sequence
gucacacuggcucacucgg

SEQ ID NO: 3577 - RNA, 19 nt, artificial sequence
  siRNA sense sequence
cgagugagccagugugacu

SEQ ID NO: 3578 - RNA, 19 nt, artificial sequence
  siRNA antisense sequence
agucacacuggcucacucg

SEQ ID NO: 3579 - RNA, 19 nt, artificial sequence
  siRNA sense sequence
agugugacugcgggagugc

SEQ ID NO: 3580 - RNA, 19 nt, artificial sequence
  siRNA antisense sequence
gcacucccgcagucacacu

SEQ ID NO: 3581 - RNA, 19 nt, artificial sequence
  siRNA sense sequence
gugugacugcgggagugca

SEQ ID NO: 3582 - RNA, 19 nt, artificial sequence
  siRNA antisense sequence
ugcacucccgcagucacac

SEQ ID NO: 3583 - RNA, 19 nt, artificial sequence
  siRNA sense sequence
ugugacugcgggagugcac

SEQ ID NO: 3584 - RNA, 19 nt, artificial sequence
  siRNA antisense sequence
gugcacucccgcagucaca

SEQ ID NO: 3585 - RNA, 19 nt, artificial sequence
  siRNA sense sequence
gugacugcgggagugcaca

SEQ ID NO: 3586 - RNA, 19 nt, artificial sequence
  siRNA antisense sequence
ugugcacucccgcagucac

SEQ ID NO: 3587 - RNA, 19 nt, artificial sequence
  siRNA sense sequence
ugacugcgggagugcacac

SEQ ID NO: 3588 - RNA, 19 nt, artificial sequence
  siRNA antisense sequence
gugugcacucccgcaguca

SEQ ID NO: 3589 - RNA, 19 nt, artificial sequence
  siRNA sense sequence
ucuacuggcucugcaggga

SEQ ID NO: 3590 - RNA, 19 nt, artificial sequence
  siRNA antisense sequence
ucccugcagagccaguaga

SEQ ID NO: 3591 - RNA, 19 nt, artificial sequence
  siRNA sense sequence
uacuggcucugcagggaca

SEQ ID NO: 3592 - RNA, 19 nt, artificial sequence
  siRNA antisense sequence
ugucccugcagagccagua

SEQ ID NO: 3593 - RNA, 19 nt, artificial sequence
  siRNA sense sequence
agguugggaagccugcccu

SEQ ID NO: 3594 - RNA, 19 nt, artificial sequence
  siRNA antisense sequence
agggcaggcuucccaaccu

SEQ ID NO: 3595 - RNA, 19 nt, artificial sequence
  siRNA sense sequence
guugggaagccugcccucu

SEQ ID NO: 3596 - RNA, 19 nt, artificial sequence
  siRNA antisense sequence
agagggcaggcuucccaac

SEQ ID NO: 3597 - RNA, 19 nt, artificial sequence
  siRNA sense sequence
uugggaagccugcccucuu

SEQ ID NO: 3598 - RNA, 19 nt, artificial sequence
  siRNA antisense sequence
aagagggcaggcuucccaa

SEQ ID NO: 3599 - RNA, 19 nt, artificial sequence
  siRNA sense sequence
gaagccugcccucuugcuc

SEQ ID NO: 3600 - RNA, 19 nt, artificial sequence
  siRNA antisense sequence
gagcaagagggcaggcuuc

SEQ ID NO: 3601 - RNA, 19 nt, artificial sequence
  siRNA sense sequence
aagccugcccucuugcucc

SEQ ID NO: 3602 - RNA, 19 nt, artificial sequence
  siRNA antisense sequence
ggagcaagagggcaggcuu

SEQ ID NO: 3603 - RNA, 19 nt, artificial sequence
  siRNA sense sequence
cucuugcuccugccuucug

SEQ ID NO: 3604 - RNA, 19 nt, artificial sequence
  siRNA antisense sequence
cagaaggcaggagcaagag

SEQ ID NO: 3605 - RNA, 19 nt, artificial sequence
  siRNA sense sequence
ucuugcuccugccuucugc

SEQ ID NO: 3606 - RNA, 19 nt, artificial sequence
  siRNA antisense sequence
gcagaaggcaggagcaaga

SEQ ID NO: 3607 - RNA, 19 nt, artificial sequence
  siRNA sense sequence
uugcuccugccuucugccc

SEQ ID NO: 3608 - RNA, 19 nt, artificial sequence
  siRNA antisense sequence
gggcagaaggcaggagcaa

SEQ ID NO: 3609 - RNA, 19 nt, artificial sequence
  siRNA sense sequence
cccugcaagucccucacca

SEQ ID NO: 3610 - RNA, 19 nt, artificial sequence
  siRNA antisense sequence
uggugagggacuugcaggg

SEQ ID NO: 3611 - RNA, 19 nt, artificial sequence
  siRNA sense sequence
ccugcaagucccucaccag

SEQ ID NO: 3612 - RNA, 19 nt, artificial sequence
  siRNA antisense sequence
cuggugagggacuugcagg

SEQ ID NO: 3613 - RNA, 19 nt, artificial sequence
  siRNA sense sequence
aagucccucaccagaguau

SEQ ID NO: 3614 - RNA, 19 nt, artificial sequence
  siRNA antisense sequence
auacucuggugagggacuu

SEQ ID NO: 3615 - RNA, 19 nt, artificial sequence
  siRNA sense sequence
agucccucaccagaguauc

SEQ ID NO: 3616 - RNA, 19 nt, artificial sequence
  siRNA antisense sequence
gauacucuggugagggacu

SEQ ID NO: 3617 - RNA, 19 nt, artificial sequence
  siRNA sense sequence
gucccucaccagaguaucc

SEQ ID NO: 3618 - RNA, 19 nt, artificial sequence
  siRNA antisense sequence
ggauacucuggugagggac

SEQ ID NO: 3619 - RNA, 19 nt, artificial sequence
  siRNA sense sequence
ucccucaccagaguauccc

SEQ ID NO: 3620 - RNA, 19 nt, artificial sequence
  siRNA antisense sequence
gggauacucuggugaggga

SEQ ID NO: 3621 - RNA, 19 nt, artificial sequence
  siRNA sense sequence
cccucugcuucagguguuc

SEQ ID NO: 3622 - RNA, 19 nt, artificial sequence
  siRNA antisense sequence
gaacaccugaagcagaggg

SEQ ID NO: 3623 - RNA, 19 nt, artificial sequence
  siRNA sense sequence
ccucugcuucagguguucu

SEQ ID NO: 3624 - RNA, 19 nt, artificial sequence
  siRNA antisense sequence
agaacaccugaagcagagg

SEQ ID NO: 3625 - RNA, 19 nt, artificial sequence
  siRNA sense sequence
cucugcuucagguguucug

SEQ ID NO: 3626 - RNA, 19 nt, artificial sequence
  siRNA antisense sequence
cagaacaccugaagcagag

SEQ ID NO: 3627 - RNA, 19 nt, artificial sequence
  siRNA sense sequence
agacuucaggcggaggcug

SEQ ID NO: 3628 - RNA, 19 nt, artificial sequence
  siRNA antisense sequence
cagccuccgccugaagucu

SEQ ID NO: 3629 - RNA, 19 nt, artificial sequence
  siRNA sense sequence
acuucaggcggaggcugga

SEQ ID NO: 3630 - RNA, 19 nt, artificial sequence
  siRNA antisense sequence
uccagccuccgccugaagu

SEQ ID NO: 3631 - RNA, 19 nt, artificial sequence
  siRNA sense sequence
gcggaggcuggaccaucau

SEQ ID NO: 3632 - RNA, 19 nt, artificial sequence
  siRNA antisense sequence
augaugguccagccuccgc

SEQ ID NO: 3633 - RNA, 19 nt, artificial sequence
  siRNA sense sequence
cggaggcuggaccaucauc

SEQ ID NO: 3634 - RNA, 19 nt, artificial sequence
  siRNA antisense sequence
gaugaugguccagccuccg

SEQ ID NO: 3635 - RNA, 19 nt, artificial sequence
  siRNA sense sequence
ggaggcuggaccaucaucc

SEQ ID NO: 3636 - RNA, 19 nt, artificial sequence
  siRNA antisense sequence
ggaugaugguccagccucc

SEQ ID NO: 3637 - RNA, 19 nt, artificial sequence
  siRNA sense sequence
aaguggccuugucuccuuc

SEQ ID NO: 3638 - RNA, 19 nt, artificial sequence
  siRNA antisense sequence
gaaggagacaaggccacuu

SEQ ID NO: 3639 - RNA, 19 nt, artificial sequence
  siRNA sense sequence
aguggccuugucuccuucu

SEQ ID NO: 3640 - RNA, 19 nt, artificial sequence
  siRNA antisense sequence
agaaggagacaaggccacu

SEQ ID NO: 3641 - RNA, 19 nt, artificial sequence
  siRNA sense sequence
guggccuugucuccuucua

SEQ ID NO: 3642 - RNA, 19 nt, artificial sequence
  siRNA antisense sequence
uagaaggagacaaggccac

SEQ ID NO: 3643 - RNA, 19 nt, artificial sequence
  siRNA sense sequence
cuugucuccuucuaccggg

SEQ ID NO: 3644 - RNA, 19 nt, artificial sequence
  siRNA antisense sequence
cccgguagaaggagacaag

SEQ ID NO: 3645 - RNA, 19 nt, artificial sequence
  siRNA sense sequence
uugucuccuucuaccggga

SEQ ID NO: 3646 - RNA, 19 nt, artificial sequence
  siRNA antisense sequence
ucccgguagaaggagacaa

SEQ ID NO: 3647 - RNA, 19 nt, artificial sequence
  siRNA sense sequence
ugucuccuucuaccgggac

SEQ ID NO: 3648 - RNA, 19 nt, artificial sequence
  siRNA antisense sequence
gucccgguagaaggagaca

SEQ ID NO: 3649 - RNA, 19 nt, artificial sequence
  siRNA sense sequence
gucuccuucuaccgggacu

SEQ ID NO: 3650 - RNA, 19 nt, artificial sequence
  siRNA antisense sequence
agucccgguagaaggagac

SEQ ID NO: 3651 - RNA, 19 nt, artificial sequence
  siRNA sense sequence
uucuaccgggacuggaagc

SEQ ID NO: 3652 - RNA, 19 nt, artificial sequence
  siRNA antisense sequence
gcuuccagucccgguagaa

SEQ ID NO: 3653 - RNA, 19 nt, artificial sequence
  siRNA sense sequence
ucuaccgggacuggaagca

SEQ ID NO: 3654 - RNA, 19 nt, artificial sequence
  siRNA antisense sequence
ugcuuccagucccgguaga

SEQ ID NO: 3655 - RNA, 19 nt, artificial sequence
  siRNA sense sequence
cuaccgggacuggaagcag

SEQ ID NO: 3656 - RNA, 19 nt, artificial sequence
  siRNA antisense sequence
cugcuuccagucccgguag

SEQ ID NO: 3657 - RNA, 19 nt, artificial sequence
  siRNA sense sequence
agcagggcuuuggcagcau

SEQ ID NO: 3658 - RNA, 19 nt, artificial sequence
  siRNA antisense sequence
augcugccaaagcccugcu

SEQ ID NO: 3659 - RNA, 19 nt, artificial sequence
  siRNA sense sequence
agggcuuuggcagcauccg

SEQ ID NO: 3660 - RNA, 19 nt, artificial sequence
  siRNA antisense sequence
cggaugcugccaaagcccu

SEQ ID NO: 3661 - RNA, 19 nt, artificial sequence
  siRNA sense sequence
gggcuuuggcagcauccgu

SEQ ID NO: 3662 - RNA, 19 nt, artificial sequence
  siRNA antisense sequence
acggaugcugccaaagccc

SEQ ID NO: 3663 - RNA, 19 nt, artificial sequence
  siRNA sense sequence
ggcuuuggcagcauccgug

SEQ ID NO: 3664 - RNA, 19 nt, artificial sequence
  siRNA antisense sequence
cacggaugcugccaaagcc

SEQ ID NO: 3665 - RNA, 19 nt, artificial sequence
  siRNA sense sequence
cauccaccggcucuccaga

SEQ ID NO: 3666 - RNA, 19 nt, artificial sequence
  siRNA antisense sequence
ucuggagagccgguggaug

SEQ ID NO: 3667 - RNA, 19 nt, artificial sequence
  siRNA sense sequence
auccaccggcucuccagac

SEQ ID NO: 3668 - RNA, 19 nt, artificial sequence
  siRNA antisense sequence
gucuggagagccgguggau

SEQ ID NO: 3669 - RNA, 19 nt, artificial sequence
  siRNA sense sequence
uccaccggcucuccagaca

SEQ ID NO: 3670 - RNA, 19 nt, artificial sequence
  siRNA antisense sequence
ugucuggagagccggugga

SEQ ID NO: 3671 - RNA, 19 nt, artificial sequence
  siRNA sense sequence
cuggaccagugccaccaca

SEQ ID NO: 3672 - RNA, 19 nt, artificial sequence
  siRNA antisense sequence
ugugguggcacugguccag

SEQ ID NO: 3673 - RNA, 19 nt, artificial sequence
  siRNA sense sequence
gggugccauuccuauucug

SEQ ID NO: 3674 - RNA, 19 nt, artificial sequence
  siRNA antisense sequence
cagaauaggaauggcaccc

SEQ ID NO: 3675 - RNA, 19 nt, artificial sequence
  siRNA sense sequence
ggugccauuccuauucuga

SEQ ID NO: 3676 - RNA, 19 nt, artificial sequence
  siRNA antisense sequence
ucagaauaggaauggcacc

SEQ ID NO: 3677 - RNA, 19 nt, artificial sequence
  siRNA sense sequence
gugccauuccuauucugau

SEQ ID NO: 3678 - RNA, 19 nt, artificial sequence
  siRNA antisense sequence
aucagaauaggaauggcac

SEQ ID NO: 3679 - RNA, 19 nt, artificial sequence
  siRNA sense sequence
ugccauuccuauucugauu

SEQ ID NO: 3680 - RNA, 19 nt, artificial sequence
  siRNA antisense sequence
aaucagaauaggaauggca

SEQ ID NO: 3681 - RNA, 19 nt, artificial sequence
  siRNA sense sequence
auuccuauucugauucaag

SEQ ID NO: 3682 - RNA, 19 nt, artificial sequence
  siRNA antisense sequence
cuugaaucagaauaggaau

SEQ ID NO: 3683 - RNA, 19 nt, artificial sequence
  siRNA sense sequence
uguauauucauugugaugg

SEQ ID NO: 3684 - RNA, 19 nt, artificial sequence
  siRNA antisense sequence
ccaucacaaugaauauaca

SEQ ID NO: 3685 - RNA, 19 nt, artificial sequence
  siRNA sense sequence
guauauucauugugauggu

SEQ ID NO: 3686 - RNA, 19 nt, artificial sequence
  siRNA antisense sequence
accaucacaaugaauauac

SEQ ID NO: 3687 - RNA, 19 nt, artificial sequence
  siRNA sense sequence
auucauugugaugguuuuc

SEQ ID NO: 3688 - RNA, 19 nt, artificial sequence
  siRNA antisense sequence
gaaaaccaucacaaugaau

SEQ ID NO: 3689 - RNA, 19 nt, artificial sequence
  siRNA sense sequence
uucauugugaugguuuucc

SEQ ID NO: 3690 - RNA, 19 nt, artificial sequence
  siRNA antisense sequence
ggaaaaccaucacaaugaa

SEQ ID NO: 3691 - RNA, 19 nt, artificial sequence
  siRNA sense sequence
ugugaugguuuuccugcaa

SEQ ID NO: 3692 - RNA, 19 nt, artificial sequence
  siRNA antisense sequence
uugcaggaaaaccaucaca

SEQ ID NO: 3693 - RNA, 19 nt, artificial sequence
  siRNA sense sequence
gugaugguuuuccugcaag

SEQ ID NO: 3694 - RNA, 19 nt, artificial sequence
  siRNA antisense sequence
cuugcaggaaaaccaucac

SEQ ID NO: 3695 - RNA, 19 nt, artificial sequence
  siRNA sense sequence
ugaugguuuuccugcaagu

SEQ ID NO: 3696 - RNA, 19 nt, artificial sequence
  siRNA antisense sequence
acuugcaggaaaaccauca

SEQ ID NO: 3697 - RNA, 19 nt, artificial sequence
  siRNA sense sequence
augguuuuccugcaaguug

SEQ ID NO: 3698 - RNA, 19 nt, artificial sequence
  siRNA antisense sequence
caacuugcaggaaaaccau

SEQ ID NO: 3699 - RNA, 19 nt, artificial sequence
  siRNA sense sequence
gguuuuccugcaaguugua

SEQ ID NO: 3700 - RNA, 19 nt, artificial sequence
  siRNA antisense sequence
uacaacuugcaggaaaacc

SEQ ID NO: 3701 - RNA, 19 nt, artificial sequence
  siRNA sense sequence
guuuuccugcaaguuguaa

SEQ ID NO: 3702 - RNA, 19 nt, artificial sequence
  siRNA antisense sequence
uuacaacuugcaggaaaac

SEQ ID NO: 3703 - RNA, 19 nt, artificial sequence
  siRNA sense sequence
uuuuccugcaaguuguaau

SEQ ID NO: 3704 - RNA, 19 nt, artificial sequence
  siRNA antisense sequence
auuacaacuugcaggaaaa

SEQ ID NO: 3705 - RNA, 19 nt, artificial sequence
  siRNA sense sequence
uuuccugcaaguuguaaug

SEQ ID NO: 3706 - RNA, 19 nt, artificial sequence
  siRNA antisense sequence
cauuacaacuugcaggaaa

SEQ ID NO: 3707 - RNA, 19 nt, artificial sequence
  siRNA sense sequence
uuccugcaaguuguaaugg

SEQ ID NO: 3708 - RNA, 19 nt, artificial sequence
  siRNA antisense sequence
ccauuacaacuugcaggaa

SEQ ID NO: 3709 - RNA, 19 nt, artificial sequence
  siRNA sense sequence
uccugcaaguuguaaugga

SEQ ID NO: 3710 - RNA, 19 nt, artificial sequence
  siRNA antisense sequence
uccauuacaacuugcagga

SEQ ID NO: 3711 - RNA, 19 nt, artificial sequence
  siRNA sense sequence
caaguuguaauggaguuga

SEQ ID NO: 3712 - RNA, 19 nt, artificial sequence
  siRNA antisense sequence
ucaacuccauuacaacuug

SEQ ID NO: 3713 - RNA, 19 nt, artificial sequence
  siRNA sense sequence
aaguuguaauggaguugag

SEQ ID NO: 3714 - RNA, 19 nt, artificial sequence
  siRNA antisense sequence
cucaacuccauuacaacuu

SEQ ID NO: 3715 - RNA, 19 nt, artificial sequence
  siRNA sense sequence
aguuguaauggaguugagg

SEQ ID NO: 3716 - RNA, 19 nt, artificial sequence
  siRNA antisense sequence
ccucaacuccauuacaacu

SEQ ID NO: 3717 - RNA, 19 nt, artificial sequence
  siRNA sense sequence
guuguaauggaguugagga

SEQ ID NO: 3718 - RNA, 19 nt, artificial sequence
  siRNA antisense sequence
uccucaacuccauuacaac

SEQ ID NO: 3719 - RNA, 19 nt, artificial sequence
  siRNA sense sequence
cugcaggugggacaggaag

SEQ ID NO: 3720 - RNA, 19 nt, artificial sequence
  siRNA antisense sequence
cuuccugucccaccugcag

SEQ ID NO: 3721 - RNA, 19 nt, artificial sequence
  siRNA sense sequence
gcaggugggacaggaagag

SEQ ID NO: 3722 - RNA, 19 nt, artificial sequence
  siRNA antisense sequence
cucuuccugucccaccugc

SEQ ID NO: 3723 - RNA, 19 nt, artificial sequence
  siRNA sense sequence
caggugggacaggaagagg

SEQ ID NO: 3724 - RNA, 19 nt, artificial sequence
  siRNA antisense sequence
ccucuuccugucccaccug

SEQ ID NO: 3725 - RNA, 19 nt, artificial sequence
  siRNA sense sequence
aggugggacaggaagaggc

SEQ ID NO: 3726 - RNA, 19 nt, artificial sequence
  siRNA antisense sequence
gccucuuccugucccaccu

SEQ ID NO: 3727 - RNA, 19 nt, artificial sequence
  siRNA sense sequence
gggacaggaagaggccaga

SEQ ID NO: 3728 - RNA, 19 nt, artificial sequence
  siRNA antisense sequence
ucuggccucuuccuguccc

SEQ ID NO: 3729 - RNA, 19 nt, artificial sequence
  siRNA sense sequence
ggacaggaagaggccagac

SEQ ID NO: 3730 - RNA, 19 nt, artificial sequence
  siRNA antisense sequence
gucuggccucuuccugucc

SEQ ID NO: 3731 - RNA, 19 nt, artificial sequence
  siRNA sense sequence
gacaggaagaggccagacc

SEQ ID NO: 3732 - RNA, 19 nt, artificial sequence
  siRNA antisense sequence
ggucuggccucuuccuguc

SEQ ID NO: 3733 - RNA, 19 nt, artificial sequence
  siRNA sense sequence
cagacccaggccagaguag

SEQ ID NO: 3734 - RNA, 19 nt, artificial sequence
  siRNA antisense sequence
cuacucuggccugggucug

SEQ ID NO: 3735 - RNA, 19 nt, artificial sequence
  siRNA sense sequence
agacccaggccagaguaga

SEQ ID NO: 3736 - RNA, 19 nt, artificial sequence
  siRNA antisense sequence
ucuacucuggccugggucu

SEQ ID NO: 3737 - RNA, 19 nt, artificial sequence
  siRNA sense sequence
gacccaggccagaguagag

SEQ ID NO: 3738 - RNA, 19 nt, artificial sequence
  siRNA antisense sequence
cucuacucuggccuggguc

SEQ ID NO: 3739 - RNA, 19 nt, artificial sequence
  siRNA sense sequence
cccaggccagaguagagca

SEQ ID NO: 3740 - RNA, 19 nt, artificial sequence
  siRNA antisense sequence
ugcucuacucuggccuggg

SEQ ID NO: 3741 - RNA, 19 nt, artificial sequence
  siRNA sense sequence
caggccagaguagagcaaa

SEQ ID NO: 3742 - RNA, 19 nt, artificial sequence
  siRNA antisense sequence
uuugcucuacucuggccug

SEQ ID NO: 3743 - RNA, 19 nt, artificial sequence
  siRNA sense sequence
gccagaguagagcaaauuc

SEQ ID NO: 3744 - RNA, 19 nt, artificial sequence
  siRNA antisense sequence
gaauuugcucuacucuggc

SEQ ID NO: 3745 - RNA, 19 nt, artificial sequence
  siRNA sense sequence
ccagaguagagcaaauuca

SEQ ID NO: 3746 - RNA, 19 nt, artificial sequence
  siRNA antisense sequence
ugaauuugcucuacucugg

SEQ ID NO: 3747 - RNA, 19 nt, artificial sequence
  siRNA sense sequence
cagaguagagcaaauucaa

SEQ ID NO: 3748 - RNA, 19 nt, artificial sequence
  siRNA antisense sequence
uugaauuugcucuacucug

SEQ ID NO: 3749 - RNA, 19 nt, artificial sequence
  siRNA sense sequence
agaguagagcaaauucaac

SEQ ID NO: 3750 - RNA, 19 nt, artificial sequence
  siRNA antisense sequence
guugaauuugcucuacucu

SEQ ID NO: 3751 - RNA, 19 nt, artificial sequence
  siRNA sense sequence
acacuagucucugcucugg

SEQ ID NO: 3752 - RNA, 19 nt, artificial sequence
  siRNA antisense sequence
ccagagcagagacuagugu

SEQ ID NO: 3753 - RNA, 19 nt, artificial sequence
  siRNA sense sequence
cacuagucucugcucuggc

SEQ ID NO: 3754 - RNA, 19 nt, artificial sequence
  siRNA antisense sequence
gccagagcagagacuagug

SEQ ID NO: 3755 - RNA, 19 nt, artificial sequence
  siRNA sense sequence
cuagucucugcucuggccg

SEQ ID NO: 3756 - RNA, 19 nt, artificial sequence
  siRNA antisense sequence
cggccagagcagagacuag

SEQ ID NO: 3757 - RNA, 19 nt, artificial sequence
  siRNA sense sequence
uagucucugcucuggccga

SEQ ID NO: 3758 - RNA, 19 nt, artificial sequence
  siRNA antisense sequence
ucggccagagcagagacua

SEQ ID NO: 3759 - RNA, 19 nt, artificial sequence
  siRNA sense sequence
agucucugcucuggccgag

SEQ ID NO: 3760 - RNA, 19 nt, artificial sequence
  siRNA antisense sequence
cucggccagagcagagacu

SEQ ID NO: 3761 - RNA, 19 nt, artificial sequence
  siRNA sense sequence
cucuggccgagcaugaggu

SEQ ID NO: 3762 - RNA, 19 nt, artificial sequence
  siRNA antisense sequence
accucaugcucggccagag

SEQ ID NO: 3763 - RNA, 19 nt, artificial sequence
  siRNA sense sequence
ucuggccgagcaugagguc

SEQ ID NO: 3764 - RNA, 19 nt, artificial sequence
  siRNA antisense sequence
gaccucaugcucggccaga

SEQ ID NO: 3765 - RNA, 19 nt, artificial sequence
  siRNA sense sequence
uggccgagcaugagguccu

SEQ ID NO: 3766 - RNA, 19 nt, artificial sequence
  siRNA antisense sequence
aggaccucaugcucggcca

SEQ ID NO: 3767 - RNA, 19 nt, artificial sequence
  siRNA sense sequence
ggccgagcaugagguccuu

SEQ ID NO: 3768 - RNA, 19 nt, artificial sequence
  siRNA antisense sequence
aaggaccucaugcucggcc

SEQ ID NO: 3769 - RNA, 19 nt, artificial sequence
  siRNA sense sequence
gccgagcaugagguccuuu

SEQ ID NO: 3770 - RNA, 19 nt, artificial sequence
  siRNA antisense sequence
aaaggaccucaugcucggc

SEQ ID NO: 3771 - RNA, 19 nt, artificial sequence
  siRNA sense sequence
ccgagcaugagguccuuua

SEQ ID NO: 3772 - RNA, 19 nt, artificial sequence
  siRNA antisense sequence
uaaaggaccucaugcucgg

SEQ ID NO: 3773 - RNA, 19 nt, artificial sequence
  siRNA sense sequence
cgagcaugagguccuuuag

SEQ ID NO: 3774 - RNA, 19 nt, artificial sequence
  siRNA antisense sequence
cuaaaggaccucaugcucg

SEQ ID NO: 3775 - RNA, 19 nt, artificial sequence
  siRNA sense sequence
gagcaugagguccuuuagg

SEQ ID NO: 3776 - RNA, 19 nt, artificial sequence
  siRNA antisense sequence
ccuaaaggaccucaugcuc

SEQ ID NO: 3777 - RNA, 19 nt, artificial sequence
  siRNA sense sequence
agcaugagguccuuuaggu

SEQ ID NO: 3778 - RNA, 19 nt, artificial sequence
  siRNA antisense sequence
accuaaaggaccucaugcu

SEQ ID NO: 3779 - RNA, 19 nt, artificial sequence
  siRNA sense sequence
gcaugagguccuuuaggug

SEQ ID NO: 3780 - RNA, 19 nt, artificial sequence
  siRNA antisense sequence
caccuaaaggaccucaugc

SEQ ID NO: 3781 - RNA, 19 nt, artificial sequence
  siRNA sense sequence
caugagguccuuuaggugc

SEQ ID NO: 3782 - RNA, 19 nt, artificial sequence
  siRNA antisense sequence
gcaccuaaaggaccucaug

SEQ ID NO: 3783 - RNA, 19 nt, artificial sequence
  siRNA sense sequence
augagguccuuuaggugca

SEQ ID NO: 3784 - RNA, 19 nt, artificial sequence
  siRNA antisense sequence
ugcaccuaaaggaccucau

SEQ ID NO: 3785 - RNA, 19 nt, artificial sequence
  siRNA sense sequence
ugagguccuuuaggugcaa

SEQ ID NO: 3786 - RNA, 19 nt, artificial sequence
  siRNA antisense sequence
uugcaccuaaaggaccuca

SEQ ID NO: 3787 - RNA, 19 nt, artificial sequence
  siRNA sense sequence
gagguccuuuaggugcaaa

SEQ ID NO: 3788 - RNA, 19 nt, artificial sequence
  siRNA antisense sequence
uuugcaccuaaaggaccuc

SEQ ID NO: 3789 - RNA, 19 nt, artificial sequence
  siRNA sense sequence
agguccuuuaggugcaaau

SEQ ID NO: 3790 - RNA, 19 nt, artificial sequence
  siRNA antisense sequence
auuugcaccuaaaggaccu

SEQ ID NO: 3791 - RNA, 19 nt, artificial sequence
  siRNA sense sequence
gguccuuuaggugcaaauc

SEQ ID NO: 3792 - RNA, 19 nt, artificial sequence
  siRNA antisense sequence
gauuugcaccuaaaggacc

SEQ ID NO: 3793 - RNA, 19 nt, artificial sequence
  siRNA sense sequence
guccuuuaggugcaaaucu

SEQ ID NO: 3794 - RNA, 19 nt, artificial sequence
  siRNA antisense sequence
agauuugcaccuaaaggac

SEQ ID NO: 3795 - RNA, 19 nt, artificial sequence
  siRNA sense sequence
uccuuuaggugcaaaucuu

SEQ ID NO: 3796 - RNA, 19 nt, artificial sequence
  siRNA antisense sequence
aagauuugcaccuaaagga

SEQ ID NO: 3797 - RNA, 19 nt, artificial sequence
  siRNA sense sequence
ccuuuaggugcaaaucuua

SEQ ID NO: 3798 - RNA, 19 nt, artificial sequence
  siRNA antisense sequence
uaagauuugcaccuaaagg

SEQ ID NO: 3799 - RNA, 19 nt, artificial sequence
  siRNA sense sequence
cuuuaggugcaaaucuuac

SEQ ID NO: 3800 - RNA, 19 nt, artificial sequence
  siRNA antisense sequence
guaagauuugcaccuaaag

SEQ ID NO: 3801 - RNA, 19 nt, artificial sequence
  siRNA sense sequence
uuuaggugcaaaucuuacu

SEQ ID NO: 3802 - RNA, 19 nt, artificial sequence
  siRNA antisense sequence
aguaagauuugcaccuaaa

SEQ ID NO: 3803 - RNA, 19 nt, artificial sequence
  siRNA sense sequence
gcaaaucuuacugauacug

SEQ ID NO: 3804 - RNA, 19 nt, artificial sequence
  siRNA antisense sequence
caguaucaguaagauuugc

SEQ ID NO: 3805 - RNA, 19 nt, artificial sequence
  siRNA sense sequence
ucuuacugauacuguuugg

SEQ ID NO: 3806 - RNA, 19 nt, artificial sequence
  siRNA antisense sequence
ccaaacaguaucaguaaga

SEQ ID NO: 3807 - RNA, 19 nt, artificial sequence
  siRNA sense sequence
aaagcacucacuauauccu

SEQ ID NO: 3808 - RNA, 19 nt, artificial sequence
  siRNA antisense sequence
aggauauagugagugcuuu

SEQ ID NO: 3809 - RNA, 19 nt, artificial sequence
  siRNA sense sequence
aagcacucacuauauccuc

SEQ ID NO: 3810 - RNA, 19 nt, artificial sequence
  siRNA antisense sequence
gaggauauagugagugcuu

SEQ ID NO: 3811 - RNA, 19 nt, artificial sequence
  siRNA sense sequence
acucacuauauccucaugu

SEQ ID NO: 3812 - RNA, 19 nt, artificial sequence
  siRNA antisense sequence
acaugaggauauagugagu

SEQ ID NO: 3813 - RNA, 19 nt, artificial sequence
  siRNA sense sequence
ucacuauauccucauguuu

SEQ ID NO: 3814 - RNA, 19 nt, artificial sequence
  siRNA antisense sequence
aaacaugaggauauaguga

SEQ ID NO: 3815 - RNA, 19 nt, artificial sequence
  siRNA sense sequence
uauccucauguuucucuua

SEQ ID NO: 3816 - RNA, 19 nt, artificial sequence
  siRNA antisense sequence
uaagagaaacaugaggaua

SEQ ID NO: 3817 - RNA, 19 nt, artificial sequence
  siRNA sense sequence
auccucauguuucucuuac

SEQ ID NO: 3818 - RNA, 19 nt, artificial sequence
  siRNA antisense sequence
guaagagaaacaugaggau

SEQ ID NO: 3819 - RNA, 19 nt, artificial sequence
  siRNA sense sequence
uccucauguuucucuuaca

SEQ ID NO: 3820 - RNA, 19 nt, artificial sequence
  siRNA antisense sequence
uguaagagaaacaugagga

SEQ ID NO: 3821 - RNA, 19 nt, artificial sequence
  siRNA sense sequence
cucauguuucucuuacagc

SEQ ID NO: 3822 - RNA, 19 nt, artificial sequence
  siRNA antisense sequence
gcuguaagagaaacaugag

SEQ ID NO: 3823 - RNA, 19 nt, artificial sequence
  siRNA sense sequence
ucauguuucucuuacagca

SEQ ID NO: 3824 - RNA, 19 nt, artificial sequence
  siRNA antisense sequence
ugcuguaagagaaacauga

SEQ ID NO: 3825 - RNA, 19 nt, artificial sequence
  siRNA sense sequence
uucucuuacagcagcucug

SEQ ID NO: 3826 - RNA, 19 nt, artificial sequence
  siRNA antisense sequence
cagagcugcuguaagagaa

SEQ ID NO: 3827 - RNA, 19 nt, artificial sequence
  siRNA sense sequence
gcagcucugugugggauuc

SEQ ID NO: 3828 - RNA, 19 nt, artificial sequence
  siRNA antisense sequence
gaaucccacacagagcugc

SEQ ID NO: 3829 - RNA, 19 nt, artificial sequence
  siRNA sense sequence
acauagcugcaccuuauaa

SEQ ID NO: 3830 - RNA, 19 nt, artificial sequence
  siRNA antisense sequence
uuauaaggugcagcuaugu

SEQ ID NO: 3831 - RNA, 19 nt, artificial sequence
  siRNA sense sequence
cauagcugcaccuuauaag

SEQ ID NO: 3832 - RNA, 19 nt, artificial sequence
  siRNA antisense sequence
cuuauaaggugcagcuaug

SEQ ID NO: 3833 - RNA, 19 nt, artificial sequence
  siRNA sense sequence
auagcugcaccuuauaagc

SEQ ID NO: 3834 - RNA, 19 nt, artificial sequence
  siRNA antisense sequence
gcuuauaaggugcagcuau

SEQ ID NO: 3835 - RNA, 19 nt, artificial sequence
  siRNA sense sequence
uagcugcaccuuauaagca

SEQ ID NO: 3836 - RNA, 19 nt, artificial sequence
  siRNA antisense sequence
ugcuuauaaggugcagcua

SEQ ID NO: 3837 - RNA, 19 nt, artificial sequence
  siRNA sense sequence
agacuaaucaaggccauau

SEQ ID NO: 3838 - RNA, 19 nt, artificial sequence
  siRNA antisense sequence
auauggccuugauuagucu

SEQ ID NO: 3839 - RNA, 19 nt, artificial sequence
  siRNA sense sequence
gacuaaucaaggccauaug

SEQ ID NO: 3840 - RNA, 19 nt, artificial sequence
  siRNA antisense sequence
cauauggccuugauuaguc

SEQ ID NO: 3841 - RNA, 19 nt, artificial sequence
  siRNA sense sequence
acuaaucaaggccauaugg

SEQ ID NO: 3842 - RNA, 19 nt, artificial sequence
  siRNA antisense sequence
ccauauggccuugauuagu

SEQ ID NO: 3843 - RNA, 19 nt, artificial sequence
  siRNA sense sequence
cuaaucaaggccauauggu

SEQ ID NO: 3844 - RNA, 19 nt, artificial sequence
  siRNA antisense sequence
accauauggccuugauuag

SEQ ID NO: 3845 - RNA, 19 nt, artificial sequence
  siRNA sense sequence
uaaucaaggccauauggug

SEQ ID NO: 3846 - RNA, 19 nt, artificial sequence
  siRNA antisense sequence
caccauauggccuugauua

SEQ ID NO: 3847 - RNA, 19 nt, artificial sequence
  siRNA sense sequence
aaucaaggccauaugguga

SEQ ID NO: 3848 - RNA, 19 nt, artificial sequence
  siRNA antisense sequence
ucaccauauggccuugauu

SEQ ID NO: 3849 - RNA, 19 nt, artificial sequence
  siRNA sense sequence
aucaaggccauauggugaa

SEQ ID NO: 3850 - RNA, 19 nt, artificial sequence
  siRNA antisense sequence
uucaccauauggccuugau

SEQ ID NO: 3851 - RNA, 19 nt, artificial sequence
  siRNA sense sequence
ucaaggccauauggugaau

SEQ ID NO: 3852 - RNA, 19 nt, artificial sequence
  siRNA antisense sequence
auucaccauauggccuuga

SEQ ID NO: 3853 - RNA, 19 nt, artificial sequence
  siRNA sense sequence
caaggccauauggugaauc

SEQ ID NO: 3854 - RNA, 19 nt, artificial sequence
  siRNA antisense sequence
gauucaccauauggccuug

SEQ ID NO: 3855 - RNA, 19 nt, artificial sequence
  siRNA sense sequence
aaggccauauggugaauca

SEQ ID NO: 3856 - RNA, 19 nt, artificial sequence
  siRNA antisense sequence
ugauucaccauauggccuu

SEQ ID NO: 3857 - RNA, 19 nt, artificial sequence
  siRNA sense sequence
aaagaaguucgagccuugu

SEQ ID NO: 3858 - RNA, 19 nt, artificial sequence
  siRNA antisense sequence
acaaggcucgaacuucuuu

SEQ ID NO: 3859 - RNA, 19 nt, artificial sequence
  siRNA sense sequence
aagaaguucgagccuuguu

SEQ ID NO: 3860 - RNA, 19 nt, artificial sequence
  siRNA antisense sequence
aacaaggcucgaacuucuu

SEQ ID NO: 3861 - RNA, 19 nt, artificial sequence
  siRNA sense sequence
agaaguucgagccuuguuu

SEQ ID NO: 3862 - RNA, 19 nt, artificial sequence
  siRNA antisense sequence
aaacaaggcucgaacuucu

SEQ ID NO: 3863 - RNA, 19 nt, artificial sequence
  siRNA sense sequence
gaaguucgagccuuguuuu

SEQ ID NO: 3864 - RNA, 19 nt, artificial sequence
  siRNA antisense sequence
aaaacaaggcucgaacuuc

SEQ ID NO: 3865 - RNA, 19 nt, artificial sequence
  siRNA sense sequence
aaguucgagccuuguuuuc

SEQ ID NO: 3866 - RNA, 19 nt, artificial sequence
  siRNA antisense sequence
gaaaacaaggcucgaacuu

SEQ ID NO: 3867 - RNA, 19 nt, artificial sequence
  siRNA sense sequence
aguucgagccuuguuuucu

SEQ ID NO: 3868 - RNA, 19 nt, artificial sequence
  siRNA antisense sequence
agaaaacaaggcucgaacu

SEQ ID NO: 3869 - RNA, 19 nt, artificial sequence
  siRNA sense sequence
guucgagccuuguuuucug

SEQ ID NO: 3870 - RNA, 19 nt, artificial sequence
  siRNA antisense sequence
cagaaaacaaggcucgaac

SEQ ID NO: 3871 - RNA, 19 nt, artificial sequence
  siRNA sense sequence
uucgagccuuguuuucuga

SEQ ID NO: 3872 - RNA, 19 nt, artificial sequence
  siRNA antisense sequence
ucagaaaacaaggcucgaa

SEQ ID NO: 3873 - RNA, 19 nt, artificial sequence
  siRNA sense sequence
ucgagccuuguuuucugau

SEQ ID NO: 3874 - RNA, 19 nt, artificial sequence
  siRNA antisense sequence
aucagaaaacaaggcucga

SEQ ID NO: 3875 - RNA, 19 nt, artificial sequence
  siRNA sense sequence
cgagccuuguuuucugauu

SEQ ID NO: 3876 - RNA, 19 nt, artificial sequence
  siRNA antisense sequence
aaucagaaaacaaggcucg

SEQ ID NO: 3877 - RNA, 19 nt, artificial sequence
  siRNA sense sequence
uucugauucccagguuaac

SEQ ID NO: 3878 - RNA, 19 nt, artificial sequence
  siRNA antisense sequence
guuaaccugggaaucagaa

SEQ ID NO: 3879 - RNA, 19 nt, artificial sequence
  siRNA sense sequence
aaaagauguuuggcuaugg

SEQ ID NO: 3880 - RNA, 19 nt, artificial sequence
  siRNA antisense sequence
ccauagccaaacaucuuuu

SEQ ID NO: 3881 - RNA, 19 nt, artificial sequence
  siRNA sense sequence
aaagauguuuggcuauggg

SEQ ID NO: 3882 - RNA, 19 nt, artificial sequence
  siRNA antisense sequence
cccauagccaaacaucuuu

SEQ ID NO: 3883 - RNA, 19 nt, artificial sequence
  siRNA sense sequence
aagauguuuggcuauggga

SEQ ID NO: 3884 - RNA, 19 nt, artificial sequence
  siRNA antisense sequence
ucccauagccaaacaucuu

SEQ ID NO: 3885 - RNA, 19 nt, artificial sequence
  siRNA sense sequence
agauguuuggcuaugggac

SEQ ID NO: 3886 - RNA, 19 nt, artificial sequence
  siRNA antisense sequence
gucccauagccaaacaucu

SEQ ID NO: 3887 - RNA, 19 nt, artificial sequence
  siRNA sense sequence
gauguuuggcuaugggacu

SEQ ID NO: 3888 - RNA, 19 nt, artificial sequence
  siRNA antisense sequence
agucccauagccaaacauc

SEQ ID NO: 3889 - RNA, 19 nt, artificial sequence
  siRNA sense sequence
uuuggcuaugggacuguca

SEQ ID NO: 3890 - RNA, 19 nt, artificial sequence
  siRNA antisense sequence
ugacagucccauagccaaa

SEQ ID NO: 3891 - RNA, 19 nt, artificial sequence
  siRNA sense sequence
uuggcuaugggacugucag

SEQ ID NO: 3892 - RNA, 19 nt, artificial sequence
  siRNA antisense sequence
cugacagucccauagccaa

SEQ ID NO: 3893 - RNA, 19 nt, artificial sequence
  siRNA sense sequence
uggcuaugggacugucagg

SEQ ID NO: 3894 - RNA, 19 nt, artificial sequence
  siRNA antisense sequence
ccugacagucccauagcca

SEQ ID NO: 3895 - RNA, 19 nt, artificial sequence
  siRNA sense sequence
gagccugcugcacuuucuu

SEQ ID NO: 3896 - RNA, 19 nt, artificial sequence
  siRNA antisense sequence
aagaaagugcagcaggcuc

SEQ ID NO: 3897 - RNA, 19 nt, artificial sequence
  siRNA sense sequence
cugcugcacuuucuuuaag

SEQ ID NO: 3898 - RNA, 19 nt, artificial sequence
  siRNA antisense sequence
cuuaaagaaagugcagcag

SEQ ID NO: 3899 - RNA, 19 nt, artificial sequence
  siRNA sense sequence
ugcugcacuuucuuuaagg

SEQ ID NO: 3900 - RNA, 19 nt, artificial sequence
  siRNA antisense sequence
ccuuaaagaaagugcagca

SEQ ID NO: 3901 - RNA, 19 nt, artificial sequence
  siRNA sense sequence
gcugcacuuucuuuaaggc

SEQ ID NO: 3902 - RNA, 19 nt, artificial sequence
  siRNA antisense sequence
gccuuaaagaaagugcagc

SEQ ID NO: 3903 - RNA, 19 nt, artificial sequence
  siRNA sense sequence
ugcacuuucuuuaaggcuc

SEQ ID NO: 3904 - RNA, 19 nt, artificial sequence
  siRNA antisense sequence
gagccuuaaagaaagugca

SEQ ID NO: 3905 - RNA, 19 nt, artificial sequence
  siRNA sense sequence
gcacuuucuuuaaggcucu

SEQ ID NO: 3906 - RNA, 19 nt, artificial sequence
  siRNA antisense sequence
agagccuuaaagaaagugc

SEQ ID NO: 3907 - RNA, 19 nt, artificial sequence
  siRNA sense sequence
cacuuucuuuaaggcucug

SEQ ID NO: 3908 - RNA, 19 nt, artificial sequence
  siRNA antisense sequence
cagagccuuaaagaaagug

SEQ ID NO: 3909 - RNA, 19 nt, artificial sequence
  siRNA sense sequence
uucuuuaaggcucugcucc

SEQ ID NO: 3910 - RNA, 19 nt, artificial sequence
  siRNA antisense sequence
ggagcagagccuuaaagaa

SEQ ID NO: 3911 - RNA, 19 nt, artificial sequence
  siRNA sense sequence
gcucugcuccuccugacag

SEQ ID NO: 3912 - RNA, 19 nt, artificial sequence
  siRNA antisense sequence
cugucaggaggagcagagc

SEQ ID NO: 3913 - RNA, 19 nt, artificial sequence
  siRNA sense sequence
aggacugggagggcaaccu

SEQ ID NO: 3914 - RNA, 19 nt, artificial sequence
  siRNA antisense sequence
agguugcccucccaguccu

SEQ ID NO: 3915 - RNA, 19 nt, artificial sequence
  siRNA sense sequence
gcaaccugcgcuacgcuga

SEQ ID NO: 3916 - RNA, 19 nt, artificial sequence
  siRNA antisense sequence
ucagcguagcgcagguugc

SEQ ID NO: 3917 - RNA, 19 nt, artificial sequence
  siRNA sense sequence
caaccugcgcuacgcugag

SEQ ID NO: 3918 - RNA, 19 nt, artificial sequence
  siRNA antisense sequence
cucagcguagcgcagguug

SEQ ID NO: 3919 - RNA, 19 nt, artificial sequence
  siRNA sense sequence
cugcgcuacgcugaguaua

SEQ ID NO: 3920 - RNA, 19 nt, artificial sequence
  siRNA antisense sequence
uauacucagcguagcgcag

SEQ ID NO: 3921 - RNA, 19 nt, artificial sequence
  siRNA sense sequence
ugcgcuacgcugaguauag

SEQ ID NO: 3922 - RNA, 19 nt, artificial sequence
  siRNA antisense sequence
cuauacucagcguagcgca

SEQ ID NO: 3923 - RNA, 19 nt, artificial sequence
  siRNA sense sequence
cuacgcugaguauagccac

SEQ ID NO: 3924 - RNA, 19 nt, artificial sequence
  siRNA antisense sequence
guggcuauacucagcguag

SEQ ID NO: 3925 - RNA, 19 nt, artificial sequence
  siRNA sense sequence
uacgcugaguauagccacu

SEQ ID NO: 3926 - RNA, 19 nt, artificial sequence
  siRNA antisense sequence
aguggcuauacucagcgua

SEQ ID NO: 3927 - RNA, 19 nt, artificial sequence
  siRNA sense sequence
cacuuuguuuugggcaaug

SEQ ID NO: 3928 - RNA, 19 nt, artificial sequence
  siRNA antisense sequence
cauugcccaaaacaaagug

SEQ ID NO: 3929 - RNA, 19 nt, artificial sequence
  siRNA sense sequence
aacuacacuggcaaugugg

SEQ ID NO: 3930 - RNA, 19 nt, artificial sequence
  siRNA antisense sequence
ccacauugccaguguaguu

SEQ ID NO: 3931 - RNA, 19 nt, artificial sequence
  siRNA sense sequence
acuacacuggcaauguggg

SEQ ID NO: 3932 - RNA, 19 nt, artificial sequence
  siRNA antisense sequence
cccacauugccaguguagu

SEQ ID NO: 3933 - RNA, 19 nt, artificial sequence
  siRNA sense sequence
aacgacgcccuccaguauc

SEQ ID NO: 3934 - RNA, 19 nt, artificial sequence
  siRNA antisense sequence
gauacuggagggcgucguu

SEQ ID NO: 3935 - RNA, 19 nt, artificial sequence
  siRNA sense sequence
acgacgcccuccaguauca

SEQ ID NO: 3936 - RNA, 19 nt, artificial sequence
  siRNA antisense sequence
ugauacuggagggcgucgu

SEQ ID NO: 3937 - RNA, 19 nt, artificial sequence
  siRNA sense sequence
cgacgcccuccaguaucau

SEQ ID NO: 3938 - RNA, 19 nt, artificial sequence
  siRNA antisense sequence
augauacuggagggcgucg

SEQ ID NO: 3939 - RNA, 19 nt, artificial sequence
  siRNA sense sequence
gacgcccuccaguaucaua

SEQ ID NO: 3940 - RNA, 19 nt, artificial sequence
  siRNA antisense sequence
uaugauacuggagggcguc

SEQ ID NO: 3941 - RNA, 19 nt, artificial sequence
  siRNA sense sequence
acgcccuccaguaucauaa

SEQ ID NO: 3942 - RNA, 19 nt, artificial sequence
  siRNA antisense sequence
uuaugauacuggagggcgu

SEQ ID NO: 3943 - RNA, 19 nt, artificial sequence
  siRNA sense sequence
cgcccuccaguaucauaac

SEQ ID NO: 3944 - RNA, 19 nt, artificial sequence
  siRNA antisense sequence
guuaugauacuggagggcg

SEQ ID NO: 3945 - RNA, 19 nt, artificial sequence
  siRNA sense sequence
caagugugcacagcuccgc

SEQ ID NO: 3946 - RNA, 19 nt, artificial sequence
  siRNA antisense sequence
gcggagcugugcacacuug

SEQ ID NO: 3947 - RNA, 19 nt, artificial sequence
  siRNA sense sequence
aagugugcacagcuccgca

SEQ ID NO: 3948 - RNA, 19 nt, artificial sequence
  siRNA antisense sequence
ugcggagcugugcacacuu

SEQ ID NO: 3949 - RNA, 19 nt, artificial sequence
  siRNA sense sequence
agugugcacagcuccgcaa

SEQ ID NO: 3950 - RNA, 19 nt, artificial sequence
  siRNA antisense sequence
uugcggagcugugcacacu

SEQ ID NO: 3951 - RNA, 19 nt, artificial sequence
  siRNA sense sequence
ugcacagcuccgcaaaggu

SEQ ID NO: 3952 - RNA, 19 nt, artificial sequence
  siRNA antisense sequence
accuuugcggagcugugca

SEQ ID NO: 3953 - RNA, 19 nt, artificial sequence
  siRNA sense sequence
gcacagcuccgcaaaggug

SEQ ID NO: 3954 - RNA, 19 nt, artificial sequence
  siRNA antisense sequence
caccuuugcggagcugugc

SEQ ID NO: 3955 - RNA, 19 nt, artificial sequence
  siRNA sense sequence
cacagcuccgcaaagguga

SEQ ID NO: 3956 - RNA, 19 nt, artificial sequence
  siRNA antisense sequence
ucaccuuugcggagcugug

SEQ ID NO: 3957 - RNA, 19 nt, artificial sequence
  siRNA sense sequence
acagcuccgcaaaggugag

SEQ ID NO: 3958 - RNA, 19 nt, artificial sequence
  siRNA antisense sequence
cucaccuuugcggagcugu

SEQ ID NO: 3959 - RNA, 19 nt, artificial sequence
  siRNA sense sequence
caagcucauaaucccacuu

SEQ ID NO: 3960 - RNA, 19 nt, artificial sequence
  siRNA antisense sequence
aagugggauuaugagcuug

SEQ ID NO: 3961 - RNA, 19 nt, artificial sequence
  siRNA sense sequence
cauaaucccacuugaggag

SEQ ID NO: 3962 - RNA, 19 nt, artificial sequence
  siRNA antisense sequence
cuccucaagugggauuaug

SEQ ID NO: 3963 - RNA, 19 nt, artificial sequence
  siRNA sense sequence
acuguacaguugauauucc

SEQ ID NO: 3964 - RNA, 19 nt, artificial sequence
  siRNA antisense sequence
ggaauaucaacuguacagu

SEQ ID NO: 3965 - RNA, 19 nt, artificial sequence
  siRNA sense sequence
cuguacaguugauauuccg

SEQ ID NO: 3966 - RNA, 19 nt, artificial sequence
  siRNA antisense sequence
cggaauaucaacuguacag

SEQ ID NO: 3967 - RNA, 19 nt, artificial sequence
  siRNA sense sequence
uguacaguugauauuccgg

SEQ ID NO: 3968 - RNA, 19 nt, artificial sequence
  siRNA antisense sequence
ccggaauaucaacuguaca

SEQ ID NO: 3969 - RNA, 19 nt, artificial sequence
  siRNA sense sequence
guacaguugauauuccggu

SEQ ID NO: 3970 - RNA, 19 nt, artificial sequence
  siRNA antisense sequence
accggaauaucaacuguac

SEQ ID NO: 3971 - RNA, 19 nt, artificial sequence
  siRNA sense sequence
uacaguugauauuccgguu

SEQ ID NO: 3972 - RNA, 19 nt, artificial sequence
  siRNA antisense sequence
aaccggaauaucaacugua

SEQ ID NO: 3973 - RNA, 19 nt, artificial sequence
  siRNA sense sequence
acaguugauauuccgguuu

SEQ ID NO: 3974 - RNA, 19 nt, artificial sequence
  siRNA antisense sequence
aaaccggaauaucaacugu

SEQ ID NO: 3975 - RNA, 19 nt, artificial sequence
  siRNA sense sequence
caguugauauuccgguuuu

SEQ ID NO: 3976 - RNA, 19 nt, artificial sequence
  siRNA antisense sequence
aaaaccggaauaucaacug

SEQ ID NO: 3977 - RNA, 19 nt, artificial sequence
  siRNA sense sequence
aguugauauuccgguuuug

SEQ ID NO: 3978 - RNA, 19 nt, artificial sequence
  siRNA antisense sequence
caaaaccggaauaucaacu

SEQ ID NO: 3979 - RNA, 19 nt, artificial sequence
  siRNA sense sequence
guugauauuccgguuuugg

SEQ ID NO: 3980 - RNA, 19 nt, artificial sequence
  siRNA antisense sequence
ccaaaaccggaauaucaac

SEQ ID NO: 3981 - RNA, 19 nt, artificial sequence
  siRNA sense sequence
uugauauuccgguuuuggu

SEQ ID NO: 3982 - RNA, 19 nt, artificial sequence
  siRNA antisense sequence
accaaaaccggaauaucaa

SEQ ID NO: 3983 - RNA, 19 nt, artificial sequence
  siRNA sense sequence
ugauauuccgguuuuggua

SEQ ID NO: 3984 - RNA, 19 nt, artificial sequence
  siRNA antisense sequence
uaccaaaaccggaauauca

SEQ ID NO: 3985 - RNA, 19 nt, artificial sequence
  siRNA sense sequence
gauauuccgguuuugguau

SEQ ID NO: 3986 - RNA, 19 nt, artificial sequence
  siRNA antisense sequence
auaccaaaaccggaauauc

SEQ ID NO: 3987 - RNA, 19 nt, artificial sequence
  siRNA sense sequence
auauuccgguuuugguauu

SEQ ID NO: 3988 - RNA, 19 nt, artificial sequence
  siRNA antisense sequence
aauaccaaaaccggaauau

SEQ ID NO: 3989 - RNA, 19 nt, artificial sequence
  siRNA sense sequence
uauuccgguuuugguauuc

SEQ ID NO: 3990 - RNA, 19 nt, artificial sequence
  siRNA antisense sequence
gaauaccaaaaccggaaua

SEQ ID NO: 3991 - RNA, 19 nt, artificial sequence
  siRNA sense sequence
auuccgguuuugguauucu

SEQ ID NO: 3992 - RNA, 19 nt, artificial sequence
  siRNA antisense sequence
agaauaccaaaaccggaau

SEQ ID NO: 3993 - RNA, 19 nt, artificial sequence
  siRNA sense sequence
uuccgguuuugguauucuu

SEQ ID NO: 3994 - RNA, 19 nt, artificial sequence
  siRNA antisense sequence
aagaauaccaaaaccggaa

SEQ ID NO: 3995 - RNA, 19 nt, artificial sequence
  siRNA sense sequence
gguuuugguauucuuucug

SEQ ID NO: 3996 - RNA, 19 nt, artificial sequence
  siRNA antisense sequence
cagaaagaauaccaaaacc

SEQ ID NO: 3997 - RNA, 19 nt, artificial sequence
  siRNA sense sequence
uuuugguauucuuucugac

SEQ ID NO: 3998 - RNA, 19 nt, artificial sequence
  siRNA antisense sequence
gucagaaagaauaccaaaa

SEQ ID NO: 3999 - RNA, 19 nt, artificial sequence
  siRNA sense sequence
gguauucuuucugacccug

SEQ ID NO: 4000 - RNA, 19 nt, artificial sequence
  siRNA antisense sequence
cagggucagaaagaauacc

SEQ ID NO: 4001 - RNA, 19 nt, artificial sequence
  siRNA sense sequence
aacuccuuaccugaugucu

SEQ ID NO: 4002 - RNA, 19 nt, artificial sequence
  siRNA antisense sequence
agacaucagguaaggaguu

SEQ ID NO: 4003 - RNA, 19 nt, artificial sequence
  siRNA sense sequence
acuccuuaccugaugucug

SEQ ID NO: 4004 - RNA, 19 nt, artificial sequence
  siRNA antisense sequence
cagacaucagguaaggagu

SEQ ID NO: 4005 - RNA, 19 nt, artificial sequence
  siRNA sense sequence
cuccuuaccugaugucugg

SEQ ID NO: 4006 - RNA, 19 nt, artificial sequence
  siRNA antisense sequence
ccagacaucagguaaggag

SEQ ID NO: 4007 - RNA, 19 nt, artificial sequence
  siRNA sense sequence
uccuuaccugaugucuggu

SEQ ID NO: 4008 - RNA, 19 nt, artificial sequence
  siRNA antisense sequence
accagacaucagguaagga

SEQ ID NO: 4009 - RNA, 19 nt, artificial sequence
  siRNA sense sequence
ccuuaccugaugucugguc

SEQ ID NO: 4010 - RNA, 19 nt, artificial sequence
  siRNA antisense sequence
gaccagacaucagguaagg

SEQ ID NO: 4011 - RNA, 19 nt, artificial sequence
  siRNA sense sequence
cuuaccugaugucuggucu

SEQ ID NO: 4012 - RNA, 19 nt, artificial sequence
  siRNA antisense sequence
agaccagacaucagguaag

SEQ ID NO: 4013 - RNA, 19 nt, artificial sequence
  siRNA sense sequence
uuaccugaugucuggucua

SEQ ID NO: 4014 - RNA, 19 nt, artificial sequence
  siRNA antisense sequence
uagaccagacaucagguaa

SEQ ID NO: 4015 - RNA, 19 nt, artificial sequence
  siRNA sense sequence
uaccugaugucuggucuau

SEQ ID NO: 4016 - RNA, 19 nt, artificial sequence
  siRNA antisense sequence
auagaccagacaucaggua

SEQ ID NO: 4017 - RNA, 19 nt, artificial sequence
  siRNA sense sequence
accugaugucuggucuauc

SEQ ID NO: 4018 - RNA, 19 nt, artificial sequence
  siRNA antisense sequence
gauagaccagacaucaggu

SEQ ID NO: 4019 - RNA, 19 nt, artificial sequence
  siRNA sense sequence
gaugucuggucuaucacag

SEQ ID NO: 4020 - RNA, 19 nt, artificial sequence
  siRNA antisense sequence
cugugauagaccagacauc

SEQ ID NO: 4021 - RNA, 19 nt, artificial sequence
  siRNA sense sequence
augucuggucuaucacagu

SEQ ID NO: 4022 - RNA, 19 nt, artificial sequence
  siRNA antisense sequence
acugugauagaccagacau

SEQ ID NO: 4023 - RNA, 19 nt, artificial sequence
  siRNA sense sequence
ugucuggucuaucacaguc

SEQ ID NO: 4024 - RNA, 19 nt, artificial sequence
  siRNA antisense sequence
gacugugauagaccagaca

SEQ ID NO: 4025 - RNA, 19 nt, artificial sequence
  siRNA sense sequence
gucuggucuaucacaguca

SEQ ID NO: 4026 - RNA, 19 nt, artificial sequence
  siRNA antisense sequence
ugacugugauagaccagac

SEQ ID NO: 4027 - RNA, 19 nt, artificial sequence
  siRNA sense sequence
ucuggucuaucacagucaa

SEQ ID NO: 4028 - RNA, 19 nt, artificial sequence
  siRNA antisense sequence
uugacugugauagaccaga

SEQ ID NO: 4029 - RNA, 19 nt, artificial sequence
  siRNA sense sequence
cuggucuaucacagucaac

SEQ ID NO: 4030 - RNA, 19 nt, artificial sequence
  siRNA antisense sequence
guugacugugauagaccag

SEQ ID NO: 4031 - RNA, 19 nt, artificial sequence
  siRNA sense sequence
uggucuaucacagucaacu

SEQ ID NO: 4032 - RNA, 19 nt, artificial sequence
  siRNA antisense sequence
aguugacugugauagacca

SEQ ID NO: 4033 - RNA, 19 nt, artificial sequence
  siRNA sense sequence
cuaucacagucaacuuacu

SEQ ID NO: 4034 - RNA, 19 nt, artificial sequence
  siRNA antisense sequence
aguaaguugacugugauag

SEQ ID NO: 4035 - RNA, 19 nt, artificial sequence
  siRNA sense sequence
uaucacagucaacuuacua

SEQ ID NO: 4036 - RNA, 19 nt, artificial sequence
  siRNA antisense sequence
uaguaaguugacugugaua

SEQ ID NO: 4037 - RNA, 19 nt, artificial sequence
  siRNA sense sequence
acagucaacuuacuagcac

SEQ ID NO: 4038 - RNA, 19 nt, artificial sequence
  siRNA antisense sequence
gugcuaguaaguugacugu

SEQ ID NO: 4039 - RNA, 19 nt, artificial sequence
  siRNA sense sequence
aacuuacuagcacuggguc

SEQ ID NO: 4040 - RNA, 19 nt, artificial sequence
  siRNA antisense sequence
gacccagugcuaguaaguu

SEQ ID NO: 4041 - RNA, 19 nt, artificial sequence
  siRNA sense sequence
acuuacuagcacugggucu

SEQ ID NO: 4042 - RNA, 19 nt, artificial sequence
  siRNA antisense sequence
agacccagugcuaguaagu

SEQ ID NO: 4043 - RNA, 19 nt, artificial sequence
  siRNA sense sequence
cuuacuagcacugggucug

SEQ ID NO: 4044 - RNA, 19 nt, artificial sequence
  siRNA antisense sequence
cagacccagugcuaguaag

SEQ ID NO: 4045 - RNA, 19 nt, artificial sequence
  siRNA sense sequence
uuacuagcacugggucugu

SEQ ID NO: 4046 - RNA, 19 nt, artificial sequence
  siRNA antisense sequence
acagacccagugcuaguaa

SEQ ID NO: 4047 - RNA, 19 nt, artificial sequence
  siRNA sense sequence
uacuagcacugggucuguu

SEQ ID NO: 4048 - RNA, 19 nt, artificial sequence
  siRNA antisense sequence
aacagacccagugcuagua

SEQ ID NO: 4049 - RNA, 19 nt, artificial sequence
  siRNA sense sequence
acuagcacugggucuguuu

SEQ ID NO: 4050 - RNA, 19 nt, artificial sequence
  siRNA antisense sequence
aaacagacccagugcuagu

SEQ ID NO: 4051 - RNA, 19 nt, artificial sequence
  siRNA sense sequence
cugggucuguuucucaugc

SEQ ID NO: 4052 - RNA, 19 nt, artificial sequence
  siRNA antisense sequence
gcaugagaaacagacccag

SEQ ID NO: 4053 - RNA, 19 nt, artificial sequence
  siRNA sense sequence
ugggucuguuucucaugcc

SEQ ID NO: 4054 - RNA, 19 nt, artificial sequence
  siRNA antisense sequence
ggcaugagaaacagaccca

SEQ ID NO: 4055 - RNA, 19 nt, artificial sequence
  siRNA sense sequence
gggucuguuucucaugcca

SEQ ID NO: 4056 - RNA, 19 nt, artificial sequence
  siRNA antisense sequence
uggcaugagaaacagaccc

SEQ ID NO: 4057 - RNA, 19 nt, artificial sequence
  siRNA sense sequence
ggucuguuucucaugccag

SEQ ID NO: 4058 - RNA, 19 nt, artificial sequence
  siRNA antisense sequence
cuggcaugagaaacagacc

SEQ ID NO: 4059 - RNA, 19 nt, artificial sequence
  siRNA sense sequence
uguuucucaugccaggugg

SEQ ID NO: 4060 - RNA, 19 nt, artificial sequence
  siRNA antisense sequence
ccaccuggcaugagaaaca

SEQ ID NO: 4061 - RNA, 19 nt, artificial sequence
  siRNA sense sequence
guuucucaugccagguggc

SEQ ID NO: 4062 - RNA, 19 nt, artificial sequence
  siRNA antisense sequence
gccaccuggcaugagaaac

SEQ ID NO: 4063 - RNA, 19 nt, artificial sequence
  siRNA sense sequence
uuucucaugccagguggcu

SEQ ID NO: 4064 - RNA, 19 nt, artificial sequence
  siRNA antisense sequence
agccaccuggcaugagaaa

SEQ ID NO: 4065 - RNA, 19 nt, artificial sequence
  siRNA sense sequence
uucucaugccagguggcua

SEQ ID NO: 4066 - RNA, 19 nt, artificial sequence
  siRNA antisense sequence
uagccaccuggcaugagaa

SEQ ID NO: 4067 - RNA, 19 nt, artificial sequence
  siRNA sense sequence
ucucaugccagguggcuac

SEQ ID NO: 4068 - RNA, 19 nt, artificial sequence
  siRNA antisense sequence
guagccaccuggcaugaga

SEQ ID NO: 4069 - RNA, 19 nt, artificial sequence
  siRNA sense sequence
cucaugccagguggcuacu

SEQ ID NO: 4070 - RNA, 19 nt, artificial sequence
  siRNA antisense sequence
aguagccaccuggcaugag

SEQ ID NO: 4071 - RNA, 19 nt, artificial sequence
  siRNA sense sequence
caacugcugcacagacucc

SEQ ID NO: 4072 - RNA, 19 nt, artificial sequence
  siRNA antisense sequence
ggagucugugcagcaguug

SEQ ID NO: 4073 - RNA, 19 nt, artificial sequence
  siRNA sense sequence
cacagacuccaaccucaau

SEQ ID NO: 4074 - RNA, 19 nt, artificial sequence
  siRNA antisense sequence
auugagguuggagucugug

SEQ ID NO: 4075 - RNA, 19 nt, artificial sequence
  siRNA sense sequence
acagacuccaaccucaaug

SEQ ID NO: 4076 - RNA, 19 nt, artificial sequence
  siRNA antisense sequence
cauugagguuggagucugu

SEQ ID NO: 4077 - RNA, 19 nt, artificial sequence
  siRNA sense sequence
cagacuccaaccucaaugg

SEQ ID NO: 4078 - RNA, 19 nt, artificial sequence
  siRNA antisense sequence
ccauugagguuggagucug

SEQ ID NO: 4079 - RNA, 19 nt, artificial sequence
  siRNA sense sequence
ccaaccucaauggagugua

SEQ ID NO: 4080 - RNA, 19 nt, artificial sequence
  siRNA antisense sequence
uacacuccauugagguugg

SEQ ID NO: 4081 - RNA, 19 nt, artificial sequence
  siRNA sense sequence
caaccucaauggaguguac

SEQ ID NO: 4082 - RNA, 19 nt, artificial sequence
  siRNA antisense sequence
guacacuccauugagguug

SEQ ID NO: 4083 - RNA, 19 nt, artificial sequence
  siRNA sense sequence
aaccucaauggaguguacu

SEQ ID NO: 4084 - RNA, 19 nt, artificial sequence
  siRNA antisense sequence
aguacacuccauugagguu

SEQ ID NO: 4085 - RNA, 19 nt, artificial sequence
  siRNA sense sequence
accucaauggaguguacua

SEQ ID NO: 4086 - RNA, 19 nt, artificial sequence
  siRNA antisense sequence
uaguacacuccauugaggu

SEQ ID NO: 4087 - RNA, 19 nt, artificial sequence
  siRNA sense sequence
ccucaauggaguguacuac

SEQ ID NO: 4088 - RNA, 19 nt, artificial sequence
  siRNA antisense sequence
guaguacacuccauugagg

SEQ ID NO: 4089 - RNA, 19 nt, artificial sequence
  siRNA sense sequence
cucaauggaguguacuacc

SEQ ID NO: 4090 - RNA, 19 nt, artificial sequence
  siRNA antisense sequence
gguaguacacuccauugag

SEQ ID NO: 4091 - RNA, 19 nt, artificial sequence
  siRNA sense sequence
ucaauggaguguacuaccg

SEQ ID NO: 4092 - RNA, 19 nt, artificial sequence
  siRNA antisense sequence
cgguaguacacuccauuga

SEQ ID NO: 4093 - RNA, 19 nt, artificial sequence
  siRNA sense sequence
caauggaguguacuaccgc

SEQ ID NO: 4094 - RNA, 19 nt, artificial sequence
  siRNA antisense sequence
gcgguaguacacuccauug

SEQ ID NO: 4095 - RNA, 19 nt, artificial sequence
  siRNA sense sequence
aauggaguguacuaccgcc

SEQ ID NO: 4096 - RNA, 19 nt, artificial sequence
  siRNA antisense sequence
ggcgguaguacacuccauu

SEQ ID NO: 4097 - RNA, 19 nt, artificial sequence
  siRNA sense sequence
auggaguguacuaccgccu

SEQ ID NO: 4098 - RNA, 19 nt, artificial sequence
  siRNA antisense sequence
aggcgguaguacacuccau

SEQ ID NO: 4099 - RNA, 19 nt, artificial sequence
  siRNA sense sequence
uggaguguacuaccgccug

SEQ ID NO: 4100 - RNA, 19 nt, artificial sequence
  siRNA antisense sequence
caggcgguaguacacucca

SEQ ID NO: 4101 - RNA, 19 nt, artificial sequence
  siRNA sense sequence
ggaguguacuaccgccugg

SEQ ID NO: 4102 - RNA, 19 nt, artificial sequence
  siRNA antisense sequence
ccaggcgguaguacacucc

SEQ ID NO: 4103 - RNA, 19 nt, artificial sequence
  siRNA sense sequence
gaguguacuaccgccuggg

SEQ ID NO: 4104 - RNA, 19 nt, artificial sequence
  siRNA antisense sequence
cccaggcgguaguacacuc

SEQ ID NO: 4105 - RNA, 19 nt, artificial sequence
  siRNA sense sequence
aguguacuaccgccugggu

SEQ ID NO: 4106 - RNA, 19 nt, artificial sequence
  siRNA antisense sequence
acccaggcgguaguacacu

SEQ ID NO: 4107 - RNA, 19 nt, artificial sequence
  siRNA sense sequence
guacuaccgccugggugag

SEQ ID NO: 4108 - RNA, 19 nt, artificial sequence
  siRNA antisense sequence
cucacccaggcgguaguac

SEQ ID NO: 4109 - RNA, 19 nt, artificial sequence
  siRNA sense sequence
uacuaccgccugggugagc

SEQ ID NO: 4110 - RNA, 19 nt, artificial sequence
  siRNA antisense sequence
gcucacccaggcgguagua

SEQ ID NO: 4111 - RNA, 19 nt, artificial sequence
  siRNA sense sequence
acuaccgccugggugagca

SEQ ID NO: 4112 - RNA, 19 nt, artificial sequence
  siRNA antisense sequence
ugcucacccaggcgguagu

SEQ ID NO: 4113 - RNA, 19 nt, artificial sequence
  siRNA sense sequence
caauaagcaccuggauggc

SEQ ID NO: 4114 - RNA, 19 nt, artificial sequence
  siRNA antisense sequence
gccauccaggugcuuauug

SEQ ID NO: 4115 - RNA, 19 nt, artificial sequence
  siRNA sense sequence
aauaagcaccuggauggca

SEQ ID NO: 4116 - RNA, 19 nt, artificial sequence
  siRNA antisense sequence
ugccauccaggugcuuauu

SEQ ID NO: 4117 - RNA, 19 nt, artificial sequence
  siRNA sense sequence
auaagcaccuggauggcau

SEQ ID NO: 4118 - RNA, 19 nt, artificial sequence
  siRNA antisense sequence
augccauccaggugcuuau

SEQ ID NO: 4119 - RNA, 19 nt, artificial sequence
  siRNA sense sequence
uaagcaccuggauggcauc

SEQ ID NO: 4120 - RNA, 19 nt, artificial sequence
  siRNA antisense sequence
gaugccauccaggugcuua

SEQ ID NO: 4121 - RNA, 19 nt, artificial sequence
  siRNA sense sequence
aagcaccuggauggcauca

SEQ ID NO: 4122 - RNA, 19 nt, artificial sequence
  siRNA antisense sequence
ugaugccauccaggugcuu

SEQ ID NO: 4123 - RNA, 19 nt, artificial sequence
  siRNA sense sequence
agcaccuggauggcaucac

SEQ ID NO: 4124 - RNA, 19 nt, artificial sequence
  siRNA antisense sequence
gugaugccauccaggugcu

SEQ ID NO: 4125 - RNA, 19 nt, artificial sequence
  siRNA sense sequence
gcaccuggauggcaucacc

SEQ ID NO: 4126 - RNA, 19 nt, artificial sequence
  siRNA antisense sequence
ggugaugccauccaggugc

SEQ ID NO: 4127 - RNA, 19 nt, artificial sequence
  siRNA sense sequence
caccuggauggcaucaccu

SEQ ID NO: 4128 - RNA, 19 nt, artificial sequence
  siRNA antisense sequence
aggugaugccauccaggug

SEQ ID NO: 4129 - RNA, 19 nt, artificial sequence
  siRNA sense sequence
uggauggcaucaccuggua

SEQ ID NO: 4130 - RNA, 19 nt, artificial sequence
  siRNA antisense sequence
uaccaggugaugccaucca

SEQ ID NO: 4131 - RNA, 19 nt, artificial sequence
  siRNA sense sequence
uggcauggaucuaccuacu

SEQ ID NO: 4132 - RNA, 19 nt, artificial sequence
  siRNA antisense sequence
aguagguagauccaugcca

SEQ ID NO: 4133 - RNA, 19 nt, artificial sequence
  siRNA sense sequence
ggcauggaucuaccuacuc

SEQ ID NO: 4134 - RNA, 19 nt, artificial sequence
  siRNA antisense sequence
gaguagguagauccaugcc

SEQ ID NO: 4135 - RNA, 19 nt, artificial sequence
  siRNA sense sequence
gcauggaucuaccuacucc

SEQ ID NO: 4136 - RNA, 19 nt, artificial sequence
  siRNA antisense sequence
ggaguagguagauccaugc

SEQ ID NO: 4137 - RNA, 19 nt, artificial sequence
  siRNA sense sequence
cauggaucuaccuacuccc

SEQ ID NO: 4138 - RNA, 19 nt, artificial sequence
  siRNA antisense sequence
gggaguagguagauccaug

SEQ ID NO: 4139 - RNA, 19 nt, artificial sequence
  siRNA sense sequence
auggaucuaccuacucccu

SEQ ID NO: 4140 - RNA, 19 nt, artificial sequence
  siRNA antisense sequence
agggaguagguagauccau

SEQ ID NO: 4141 - RNA, 19 nt, artificial sequence
  siRNA sense sequence
uggaucuaccuacucccuc

SEQ ID NO: 4142 - RNA, 19 nt, artificial sequence
  siRNA antisense sequence
gagggaguagguagaucca

SEQ ID NO: 4143 - RNA, 19 nt, artificial sequence
  siRNA sense sequence
ggaucuaccuacucccuca

SEQ ID NO: 4144 - RNA, 19 nt, artificial sequence
  siRNA antisense sequence
ugagggaguagguagaucc

SEQ ID NO: 4145 - RNA, 19 nt, artificial sequence
  siRNA sense sequence
gaucuaccuacucccucaa

SEQ ID NO: 4146 - RNA, 19 nt, artificial sequence
  siRNA antisense sequence
uugagggaguagguagauc

SEQ ID NO: 4147 - RNA, 19 nt, artificial sequence
  siRNA sense sequence
aucuaccuacucccucaaa

SEQ ID NO: 4148 - RNA, 19 nt, artificial sequence
  siRNA antisense sequence
uuugagggaguagguagau

SEQ ID NO: 4149 - RNA, 19 nt, artificial sequence
  siRNA sense sequence
cgcccagaagacuucaagc

SEQ ID NO: 4150 - RNA, 19 nt, artificial sequence
  siRNA antisense sequence
gcuugaagucuucugggcg

SEQ ID NO: 4151 - RNA, 19 nt, artificial sequence
  siRNA sense sequence
gcccagaagacuucaagcc

SEQ ID NO: 4152 - RNA, 19 nt, artificial sequence
  siRNA antisense sequence
ggcuugaagucuucugggc

SEQ ID NO: 4153 - RNA, 19 nt, artificial sequence
  siRNA sense sequence
cccagaagacuucaagccu

SEQ ID NO: 4154 - RNA, 19 nt, artificial sequence
  siRNA antisense sequence
aggcuugaagucuucuggg

SEQ ID NO: 4155 - RNA, 19 nt, artificial sequence
  siRNA sense sequence
ccagaagacuucaagccuu

SEQ ID NO: 4156 - RNA, 19 nt, artificial sequence
  siRNA antisense sequence
aaggcuugaagucuucugg

SEQ ID NO: 4157 - RNA, 19 nt, artificial sequence
  siRNA sense sequence
cagaagacuucaagccuua

SEQ ID NO: 4158 - RNA, 19 nt, artificial sequence
  siRNA antisense sequence
uaaggcuugaagucuucug

SEQ ID NO: 4159 - RNA, 19 nt, artificial sequence
  siRNA sense sequence
gaagacuucaagccuuaaa

SEQ ID NO: 4160 - RNA, 19 nt, artificial sequence
  siRNA antisense sequence
uuuaaggcuugaagucuuc

SEQ ID NO: 4161 - RNA, 19 nt, artificial sequence
  siRNA sense sequence
aagacuucaagccuuaaaa

SEQ ID NO: 4162 - RNA, 19 nt, artificial sequence
  siRNA antisense sequence
uuuuaaggcuugaagucuu

SEQ ID NO: 4163 - RNA, 19 nt, artificial sequence
  siRNA sense sequence
agacuucaagccuuaaaag

SEQ ID NO: 4164 - RNA, 19 nt, artificial sequence
  siRNA antisense sequence
cuuuuaaggcuugaagucu

SEQ ID NO: 4165 - RNA, 19 nt, artificial sequence
  siRNA sense sequence
gacuucaagccuuaaaagg

SEQ ID NO: 4166 - RNA, 19 nt, artificial sequence
  siRNA antisense sequence
ccuuuuaaggcuugaaguc

SEQ ID NO: 4167 - RNA, 19 nt, artificial sequence
  siRNA sense sequence
acuucaagccuuaaaagga

SEQ ID NO: 4168 - RNA, 19 nt, artificial sequence
  siRNA antisense sequence
uccuuuuaaggcuugaagu

SEQ ID NO: 4169 - RNA, 19 nt, artificial sequence
  siRNA sense sequence
cuucaagccuuaaaaggag

SEQ ID NO: 4170 - RNA, 19 nt, artificial sequence
  siRNA antisense sequence
cuccuuuuaaggcuugaag

SEQ ID NO: 4171 - RNA, 19 nt, artificial sequence
  siRNA sense sequence
uucaagccuuaaaaggagg

SEQ ID NO: 4172 - RNA, 19 nt, artificial sequence
  siRNA antisense sequence
ccuccuuuuaaggcuugaa

SEQ ID NO: 4173 - RNA, 19 nt, artificial sequence
  siRNA sense sequence
ccuuaaaaggaggcugccg

SEQ ID NO: 4174 - RNA, 19 nt, artificial sequence
  siRNA antisense sequence
cggcagccuccuuuuaagg

SEQ ID NO: 4175 - RNA, 19 nt, artificial sequence
  siRNA sense sequence
cuuaaaaggaggcugccgu

SEQ ID NO: 4176 - RNA, 19 nt, artificial sequence
  siRNA antisense sequence
acggcagccuccuuuuaag

SEQ ID NO: 4177 - RNA, 19 nt, artificial sequence
  siRNA sense sequence
uuaaaaggaggcugccgug

SEQ ID NO: 4178 - RNA, 19 nt, artificial sequence
  siRNA antisense sequence
cacggcagccuccuuuuaa

SEQ ID NO: 4179 - RNA, 19 nt, artificial sequence
  siRNA sense sequence
uaaaaggaggcugccgugg

SEQ ID NO: 4180 - RNA, 19 nt, artificial sequence
  siRNA antisense sequence
ccacggcagccuccuuuua

SEQ ID NO: 4181 - RNA, 19 nt, artificial sequence
  siRNA sense sequence
aaaaggaggcugccgugga

SEQ ID NO: 4182 - RNA, 19 nt, artificial sequence
  siRNA antisense sequence
uccacggcagccuccuuuu

SEQ ID NO: 4183 - RNA, 19 nt, artificial sequence
  siRNA sense sequence
aaaggaggcugccguggag

SEQ ID NO: 4184 - RNA, 19 nt, artificial sequence
  siRNA antisense sequence
cuccacggcagccuccuuu

SEQ ID NO: 4185 - RNA, 19 nt, artificial sequence
  siRNA sense sequence
guggagcacggauacagaa

SEQ ID NO: 4186 - RNA, 19 nt, artificial sequence
  siRNA antisense sequence
uucuguauccgugcuccac

SEQ ID NO: 4187 - RNA, 19 nt, artificial sequence
  siRNA sense sequence
acuggaugagggcagauga

SEQ ID NO: 4188 - RNA, 19 nt, artificial sequence
  siRNA antisense sequence
ucaucugcccucauccagu

SEQ ID NO: 4189 - RNA, 19 nt, artificial sequence
  siRNA sense sequence
cuggaugagggcagaugag

SEQ ID NO: 4190 - RNA, 19 nt, artificial sequence
  siRNA antisense sequence
cucaucugcccucauccag

SEQ ID NO: 4191 - RNA, 19 nt, artificial sequence
  siRNA sense sequence
ggaugagggcagaugagga

SEQ ID NO: 4192 - RNA, 19 nt, artificial sequence
  siRNA antisense sequence
uccucaucugcccucaucc

SEQ ID NO: 4193 - RNA, 19 nt, artificial sequence
  siRNA sense sequence
augagggcagaugaggaca

SEQ ID NO: 4194 - RNA, 19 nt, artificial sequence
  siRNA antisense sequence
uguccucaucugcccucau

SEQ ID NO: 4195 - RNA, 19 nt, artificial sequence
  siRNA sense sequence
ugagggcagaugaggacag

SEQ ID NO: 4196 - RNA, 19 nt, artificial sequence
  siRNA antisense sequence
cuguccucaucugcccuca

SEQ ID NO: 4197 - RNA, 19 nt, artificial sequence
  siRNA sense sequence
agggcagaugaggacagga

SEQ ID NO: 4198 - RNA, 19 nt, artificial sequence
  siRNA antisense sequence
uccuguccucaucugcccu

SEQ ID NO: 4199 - RNA, 19 nt, artificial sequence
  siRNA sense sequence
ggcagaugaggacaggaag

SEQ ID NO: 4200 - RNA, 19 nt, artificial sequence
  siRNA antisense sequence
cuuccuguccucaucugcc

SEQ ID NO: 4201 - RNA, 19 nt, artificial sequence
  siRNA sense sequence
cagaugaggacaggaagag

SEQ ID NO: 4202 - RNA, 19 nt, artificial sequence
  siRNA antisense sequence
cucuuccuguccucaucug

SEQ ID NO: 4203 - RNA, 19 nt, artificial sequence
  siRNA sense sequence
gaauaagucuccaaggagc

SEQ ID NO: 4204 - RNA, 19 nt, artificial sequence
  siRNA antisense sequence
gcuccuuggagacuuauuc

SEQ ID NO: 4205 - RNA, 19 nt, artificial sequence
  siRNA sense sequence
aauaagucuccaaggagca

SEQ ID NO: 4206 - RNA, 19 nt, artificial sequence
  siRNA antisense sequence
ugcuccuuggagacuuauu

SEQ ID NO: 4207 - RNA, 19 nt, artificial sequence
  siRNA sense sequence
auaagucuccaaggagcac

SEQ ID NO: 4208 - RNA, 19 nt, artificial sequence
  siRNA antisense sequence
gugcuccuuggagacuuau

SEQ ID NO: 4209 - RNA, 19 nt, artificial sequence
  siRNA sense sequence
guaccaaggauguuacagu

SEQ ID NO: 4210 - RNA, 19 nt, artificial sequence
  siRNA antisense sequence
acuguaacauccuugguac

SEQ ID NO: 4211 - RNA, 19 nt, artificial sequence
  siRNA sense sequence
uaccaaggauguuacagua

SEQ ID NO: 4212 - RNA, 19 nt, artificial sequence
  siRNA antisense sequence
uacuguaacauccuuggua

SEQ ID NO: 4213 - RNA, 19 nt, artificial sequence
  siRNA sense sequence
accaaggauguuacaguaa

SEQ ID NO: 4214 - RNA, 19 nt, artificial sequence
  siRNA antisense sequence
uuacuguaacauccuuggu

SEQ ID NO: 4215 - RNA, 19 nt, artificial sequence
  siRNA sense sequence
ccaaggauguuacaguaaa

SEQ ID NO: 4216 - RNA, 19 nt, artificial sequence
  siRNA antisense sequence
uuuacuguaacauccuugg

SEQ ID NO: 4217 - RNA, 19 nt, artificial sequence
  siRNA sense sequence
cuggguccugccacauccu

SEQ ID NO: 4218 - RNA, 19 nt, artificial sequence
  siRNA antisense sequence
aggauguggcaggacccag

SEQ ID NO: 4219 - RNA, 19 nt, artificial sequence
  siRNA sense sequence
uggguccugccacauccuu

SEQ ID NO: 4220 - RNA, 19 nt, artificial sequence
  siRNA antisense sequence
aaggauguggcaggaccca

SEQ ID NO: 4221 - RNA, 19 nt, artificial sequence
  siRNA sense sequence
ggguccugccacauccuuc

SEQ ID NO: 4222 - RNA, 19 nt, artificial sequence
  siRNA antisense sequence
gaaggauguggcaggaccc

SEQ ID NO: 4223 - RNA, 19 nt, artificial sequence
  siRNA sense sequence
gguccugccacauccuucu

SEQ ID NO: 4224 - RNA, 19 nt, artificial sequence
  siRNA antisense sequence
agaaggauguggcaggacc

SEQ ID NO: 4225 - RNA, 19 nt, artificial sequence
  siRNA sense sequence
uccugccacauccuucuca

SEQ ID NO: 4226 - RNA, 19 nt, artificial sequence
  siRNA antisense sequence
ugagaaggauguggcagga

SEQ ID NO: 4227 - RNA, 19 nt, artificial sequence
  siRNA sense sequence
ccugccacauccuucucaa

SEQ ID NO: 4228 - RNA, 19 nt, artificial sequence
  siRNA antisense sequence
uugagaaggauguggcagg

SEQ ID NO: 4229 - RNA, 19 nt, artificial sequence
  siRNA sense sequence
cugccacauccuucucaag

SEQ ID NO: 4230 - RNA, 19 nt, artificial sequence
  siRNA antisense sequence
cuugagaaggauguggcag

SEQ ID NO: 4231 - RNA, 19 nt, artificial sequence
  siRNA sense sequence
cuucucaaggugguagacu

SEQ ID NO: 4232 - RNA, 19 nt, artificial sequence
  siRNA antisense sequence
agucuaccaccuugagaag

SEQ ID NO: 4233 - RNA, 19 nt, artificial sequence
  siRNA sense sequence
aggugguagacugaguggg

SEQ ID NO: 4234 - RNA, 19 nt, artificial sequence
  siRNA antisense sequence
cccacucagucuaccaccu

SEQ ID NO: 4235 - RNA, 19 nt, artificial sequence
  siRNA sense sequence
ggucucucugcccaagauc

SEQ ID NO: 4236 - RNA, 19 nt, artificial sequence
  siRNA antisense sequence
gaucuugggcagagagacc

SEQ ID NO: 4237 - RNA, 19 nt, artificial sequence
  siRNA sense sequence
gucucucugcccaagaucc

SEQ ID NO: 4238 - RNA, 19 nt, artificial sequence
  siRNA antisense sequence
ggaucuugggcagagagac

SEQ ID NO: 4239 - RNA, 19 nt, artificial sequence
  siRNA sense sequence
ucucucugcccaagauccc

SEQ ID NO: 4240 - RNA, 19 nt, artificial sequence
  siRNA antisense sequence
gggaucuugggcagagaga

SEQ ID NO: 4241 - RNA, 19 nt, artificial sequence
  siRNA sense sequence
ucugcccaagaucccugac

SEQ ID NO: 4242 - RNA, 19 nt, artificial sequence
  siRNA antisense sequence
gucagggaucuugggcaga

SEQ ID NO: 4243 - RNA, 19 nt, artificial sequence
  siRNA sense sequence
cugcccaagaucccugaca

SEQ ID NO: 4244 - RNA, 19 nt, artificial sequence
  siRNA antisense sequence
ugucagggaucuugggcag

SEQ ID NO: 4245 - RNA, 19 nt, artificial sequence
  siRNA sense sequence
ugcccaagaucccugacau

SEQ ID NO: 4246 - RNA, 19 nt, artificial sequence
  siRNA antisense sequence
augucagggaucuugggca

SEQ ID NO: 4247 - RNA, 19 nt, artificial sequence
  siRNA sense sequence
gcccaagaucccugacaua

SEQ ID NO: 4248 - RNA, 19 nt, artificial sequence
  siRNA antisense sequence
uaugucagggaucuugggc

SEQ ID NO: 4249 - RNA, 19 nt, artificial sequence
  siRNA sense sequence
cccaagaucccugacauag

SEQ ID NO: 4250 - RNA, 19 nt, artificial sequence
  siRNA antisense sequence
cuaugucagggaucuuggg

SEQ ID NO: 4251 - RNA, 19 nt, artificial sequence
  siRNA sense sequence
aucccugacauagcaguag

SEQ ID NO: 4252 - RNA, 19 nt, artificial sequence
  siRNA antisense sequence
cuacugcuaugucagggau

SEQ ID NO: 4253 - RNA, 19 nt, artificial sequence
  siRNA sense sequence
cccugacauagcaguagcu

SEQ ID NO: 4254 - RNA, 19 nt, artificial sequence
  siRNA antisense sequence
agcuacugcuaugucaggg

SEQ ID NO: 4255 - RNA, 19 nt, artificial sequence
  siRNA sense sequence
ccugacauagcaguagcuu

SEQ ID NO: 4256 - RNA, 19 nt, artificial sequence
  siRNA antisense sequence
aagcuacugcuaugucagg

SEQ ID NO: 4257 - RNA, 19 nt, artificial sequence
  siRNA sense sequence
cugacauagcaguagcuug

SEQ ID NO: 4258 - RNA, 19 nt, artificial sequence
  siRNA antisense sequence
caagcuacugcuaugucag

SEQ ID NO: 4259 - RNA, 19 nt, artificial sequence
  siRNA sense sequence
ugacauagcaguagcuugu

SEQ ID NO: 4260 - RNA, 19 nt, artificial sequence
  siRNA antisense sequence
acaagcuacugcuauguca

SEQ ID NO: 4261 - RNA, 19 nt, artificial sequence
  siRNA sense sequence
acauagcaguagcuugucu

SEQ ID NO: 4262 - RNA, 19 nt, artificial sequence
  siRNA antisense sequence
agacaagcuacugcuaugu

SEQ ID NO: 4263 - RNA, 19 nt, artificial sequence
  siRNA sense sequence
cauagcaguagcuugucuu

SEQ ID NO: 4264 - RNA, 19 nt, artificial sequence
  siRNA antisense sequence
aagacaagcuacugcuaug

SEQ ID NO: 4265 - RNA, 19 nt, artificial sequence
  siRNA sense sequence
gcaguagcuugucuuuucc

SEQ ID NO: 4266 - RNA, 19 nt, artificial sequence
  siRNA antisense sequence
ggaaaagacaagcuacugc

SEQ ID NO: 4267 - RNA, 19 nt, artificial sequence
  siRNA sense sequence
caguagcuugucuuuucca

SEQ ID NO: 4268 - RNA, 19 nt, artificial sequence
  siRNA antisense sequence
uggaaaagacaagcuacug

SEQ ID NO: 4269 - RNA, 19 nt, artificial sequence
  siRNA sense sequence
aguagcuugucuuuuccac

SEQ ID NO: 4270 - RNA, 19 nt, artificial sequence
  siRNA antisense sequence
guggaaaagacaagcuacu

SEQ ID NO: 4271 - RNA, 19 nt, artificial sequence
  siRNA sense sequence
guagcuugucuuuuccaca

SEQ ID NO: 4272 - RNA, 19 nt, artificial sequence
  siRNA antisense sequence
uguggaaaagacaagcuac

SEQ ID NO: 4273 - RNA, 19 nt, artificial sequence
  siRNA sense sequence
cuugucuuuuccacaugau

SEQ ID NO: 4274 - RNA, 19 nt, artificial sequence
  siRNA antisense sequence
aucauguggaaaagacaag

SEQ ID NO: 4275 - RNA, 19 nt, artificial sequence
  siRNA sense sequence
uugucuuuuccacaugauu

SEQ ID NO: 4276 - RNA, 19 nt, artificial sequence
  siRNA antisense sequence
aaucauguggaaaagacaa

SEQ ID NO: 4277 - RNA, 19 nt, artificial sequence
  siRNA sense sequence
cuuuuccacaugauuuguc

SEQ ID NO: 4278 - RNA, 19 nt, artificial sequence
  siRNA antisense sequence
gacaaaucauguggaaaag

SEQ ID NO: 4279 - RNA, 19 nt, artificial sequence
  siRNA sense sequence
uuuuccacaugauuugucu

SEQ ID NO: 4280 - RNA, 19 nt, artificial sequence
  siRNA antisense sequence
agacaaaucauguggaaaa

SEQ ID NO: 4281 - RNA, 19 nt, artificial sequence
  siRNA sense sequence
uuuccacaugauuugucug

SEQ ID NO: 4282 - RNA, 19 nt, artificial sequence
  siRNA antisense sequence
cagacaaaucauguggaaa

SEQ ID NO: 4283 - RNA, 19 nt, artificial sequence
  siRNA sense sequence
uuccacaugauuugucugu

SEQ ID NO: 4284 - RNA, 19 nt, artificial sequence
  siRNA antisense sequence
acagacaaaucauguggaa

SEQ ID NO: 4285 - RNA, 19 nt, artificial sequence
  siRNA sense sequence
gcuuaggcuaugugagggc

SEQ ID NO: 4286 - RNA, 19 nt, artificial sequence
  siRNA antisense sequence
gcccucacauagccuaagc

SEQ ID NO: 4287 - RNA, 19 nt, artificial sequence
  siRNA sense sequence
aggcuaugugagggcaaaa

SEQ ID NO: 4288 - RNA, 19 nt, artificial sequence
  siRNA antisense sequence
uuuugcccucacauagccu

SEQ ID NO: 4289 - RNA, 19 nt, artificial sequence
  siRNA sense sequence
aggagugaaggaggcaggu

SEQ ID NO: 4290 - RNA, 19 nt, artificial sequence
  siRNA antisense sequence
accugccuccuucacuccu

SEQ ID NO: 4291 - RNA, 19 nt, artificial sequence
  siRNA sense sequence
ggagugaaggaggcaggug

SEQ ID NO: 4292 - RNA, 19 nt, artificial sequence
  siRNA antisense sequence
caccugccuccuucacucc

SEQ ID NO: 4293 - RNA, 19 nt, artificial sequence
  siRNA sense sequence
gagugaaggaggcaggugg

SEQ ID NO: 4294 - RNA, 19 nt, artificial sequence
  siRNA antisense sequence
ccaccugccuccuucacuc

SEQ ID NO: 4295 - RNA, 19 nt, artificial sequence
  siRNA sense sequence
aauuaucuugagucuacac

SEQ ID NO: 4296 - RNA, 19 nt, artificial sequence
  siRNA antisense sequence
guguagacucaagauaauu

SEQ ID NO: 4297 - RNA, 19 nt, artificial sequence
  siRNA sense sequence
acuccagggcacugcaucu

SEQ ID NO: 4298 - RNA, 19 nt, artificial sequence
  siRNA antisense sequence
agaugcagugcccuggagu

SEQ ID NO: 4299 - RNA, 19 nt, artificial sequence
  siRNA sense sequence
cuccagggcacugcaucug

SEQ ID NO: 4300 - RNA, 19 nt, artificial sequence
  siRNA antisense sequence
cagaugcagugcccuggag

SEQ ID NO: 4301 - RNA, 19 nt, artificial sequence
  siRNA sense sequence
agggcacugcaucuggcga

SEQ ID NO: 4302 - RNA, 19 nt, artificial sequence
  siRNA antisense sequence
ucgccagaugcagugcccu

SEQ ID NO: 4303 - RNA, 19 nt, artificial sequence
  siRNA sense sequence
gggcacugcaucuggcgau

SEQ ID NO: 4304 - RNA, 19 nt, artificial sequence
  siRNA antisense sequence
aucgccagaugcagugccc

SEQ ID NO: 4305 - RNA, 19 nt, artificial sequence
  siRNA sense sequence
ggcacugcaucuggcgauc

SEQ ID NO: 4306 - RNA, 19 nt, artificial sequence
  siRNA antisense sequence
gaucgccagaugcagugcc

SEQ ID NO: 4307 - RNA, 19 nt, artificial sequence
  siRNA sense sequence
gcacugcaucuggcgauca

SEQ ID NO: 4308 - RNA, 19 nt, artificial sequence
  siRNA antisense sequence
ugaucgccagaugcagugc

SEQ ID NO: 4309 - RNA, 19 nt, artificial sequence
  siRNA sense sequence
cccugcucgccuuggucau

SEQ ID NO: 4310 - RNA, 19 nt, artificial sequence
  siRNA antisense sequence
augaccaaggcgagcaggg

SEQ ID NO: 4311 - RNA, 19 nt, artificial sequence
  siRNA sense sequence
ccugcucgccuuggucaug

SEQ ID NO: 4312 - RNA, 19 nt, artificial sequence
  siRNA antisense sequence
caugaccaaggcgagcagg

SEQ ID NO: 4313 - RNA, 19 nt, artificial sequence
  siRNA sense sequence
cugcucgccuuggucaugu

SEQ ID NO: 4314 - RNA, 19 nt, artificial sequence
  siRNA antisense sequence
acaugaccaaggcgagcag

SEQ ID NO: 4315 - RNA, 19 nt, artificial sequence
  siRNA sense sequence
ugcucgccuuggucaugua

SEQ ID NO: 4316 - RNA, 19 nt, artificial sequence
  siRNA antisense sequence
uacaugaccaaggcgagca

SEQ ID NO: 4317 - RNA, 19 nt, artificial sequence
  siRNA sense sequence
augaagcaccagcaggagg

SEQ ID NO: 4318 - RNA, 19 nt, artificial sequence
  siRNA antisense sequence
ccuccugcuggugcuucau

SEQ ID NO: 4319 - RNA, 19 nt, artificial sequence
  siRNA sense sequence
ugaagcaccagcaggaggu

SEQ ID NO: 4320 - RNA, 19 nt, artificial sequence
  siRNA antisense sequence
accuccugcuggugcuuca

SEQ ID NO: 4321 - RNA, 19 nt, artificial sequence
  siRNA sense sequence
cagcaggagguggacagag

SEQ ID NO: 4322 - RNA, 19 nt, artificial sequence
  siRNA antisense sequence
cucuguccaccuccugcug

SEQ ID NO: 4323 - RNA, 19 nt, artificial sequence
  siRNA sense sequence
agcaggagguggacagagu

SEQ ID NO: 4324 - RNA, 19 nt, artificial sequence
  siRNA antisense sequence
acucuguccaccuccugcu

SEQ ID NO: 4325 - RNA, 19 nt, artificial sequence
  siRNA sense sequence
gcaggagguggacagaguc

SEQ ID NO: 4326 - RNA, 19 nt, artificial sequence
  siRNA antisense sequence
gacucuguccaccuccugc

SEQ ID NO: 4327 - RNA, 19 nt, artificial sequence
  siRNA sense sequence
caggagguggacagagucu

SEQ ID NO: 4328 - RNA, 19 nt, artificial sequence
  siRNA antisense sequence
agacucuguccaccuccug

SEQ ID NO: 4329 - RNA, 19 nt, artificial sequence
  siRNA sense sequence
ggagguggacagagucucu

SEQ ID NO: 4330 - RNA, 19 nt, artificial sequence
  siRNA antisense sequence
agagacucuguccaccucc

SEQ ID NO: 4331 - RNA, 19 nt, artificial sequence
  siRNA sense sequence
agguggacagagucucuca

SEQ ID NO: 4332 - RNA, 19 nt, artificial sequence
  siRNA antisense sequence
ugagagacucuguccaccu

SEQ ID NO: 4333 - RNA, 19 nt, artificial sequence
  siRNA sense sequence
uggacagagucucucaugg

SEQ ID NO: 4334 - RNA, 19 nt, artificial sequence
  siRNA antisense sequence
ccaugagagacucugucca

SEQ ID NO: 4335 - RNA, 19 nt, artificial sequence
  siRNA sense sequence
ggacagagucucucaugga

SEQ ID NO: 4336 - RNA, 19 nt, artificial sequence
  siRNA antisense sequence
uccaugagagacucugucc

SEQ ID NO: 4337 - RNA, 19 nt, artificial sequence
  siRNA sense sequence
gacagagucucucauggau

SEQ ID NO: 4338 - RNA, 19 nt, artificial sequence
  siRNA antisense sequence
auccaugagagacucuguc

SEQ ID NO: 4339 - RNA, 19 nt, artificial sequence
  siRNA sense sequence
acagagucucucauggaug

SEQ ID NO: 4340 - RNA, 19 nt, artificial sequence
  siRNA antisense sequence
cauccaugagagacucugu

SEQ ID NO: 4341 - RNA, 19 nt, artificial sequence
  siRNA sense sequence
ggagcuuccuuuuaaauuu

SEQ ID NO: 4342 - RNA, 19 nt, artificial sequence
  siRNA antisense sequence
aaauuuaaaaggaagcucc

SEQ ID NO: 4343 - RNA, 19 nt, artificial sequence
  siRNA sense sequence
aacugaagguagauggugu

SEQ ID NO: 4344 - RNA, 19 nt, artificial sequence
  siRNA antisense sequence
acaccaucuaccuucaguu

SEQ ID NO: 4345 - RNA, 19 nt, artificial sequence
  siRNA sense sequence
acugaagguagaugguguu

SEQ ID NO: 4346 - RNA, 19 nt, artificial sequence
  siRNA antisense sequence
aacaccaucuaccuucagu

SEQ ID NO: 4347 - RNA, 19 nt, artificial sequence
  siRNA sense sequence
cugaagguagaugguguua

SEQ ID NO: 4348 - RNA, 19 nt, artificial sequence
  siRNA antisense sequence
uaacaccaucuaccuucag

SEQ ID NO: 4349 - RNA, 19 nt, artificial sequence
  siRNA sense sequence
ugaagguagaugguguuau

SEQ ID NO: 4350 - RNA, 19 nt, artificial sequence
  siRNA antisense sequence
auaacaccaucuaccuuca

SEQ ID NO: 4351 - RNA, 19 nt, artificial sequence
  siRNA sense sequence
gaagguagaugguguuaua

SEQ ID NO: 4352 - RNA, 19 nt, artificial sequence
  siRNA antisense sequence
uauaacaccaucuaccuuc

SEQ ID NO: 4353 - RNA, 19 nt, artificial sequence
  siRNA sense sequence
guagaugguguuauaguua

SEQ ID NO: 4354 - RNA, 19 nt, artificial sequence
  siRNA antisense sequence
uaacuauaacaccaucuac

SEQ ID NO: 4355 - RNA, 19 nt, artificial sequence
  siRNA sense sequence
uguaaauaagcaucucacu

SEQ ID NO: 4356 - RNA, 19 nt, artificial sequence
  siRNA antisense sequence
agugagaugcuuauuuaca

SEQ ID NO: 4357 - RNA, 19 nt, artificial sequence
  siRNA sense sequence
auaagcaucucacuuugua

SEQ ID NO: 4358 - RNA, 19 nt, artificial sequence
  siRNA antisense sequence
uacaaagugagaugcuuau

SEQ ID NO: 4359 - RNA, 19 nt, artificial sequence
  siRNA Sense Sequence
aaguggccuugucuccuuc

SEQ ID NO: 4360 - RNA, 19 nt, artificial sequence
  siRNA Antisense Sequence
gaaggagacaaggccacuu

SEQ ID NO: 4361 - RNA, 19 nt, artificial sequence
  siRNA Sense Sequence
aguggccuugucuccuucu

SEQ ID NO: 4362 - RNA, 19 nt, artificial sequence
  siRNA Antisense Sequence
agaaggagacaaggccacu

SEQ ID NO: 4363 - RNA, 19 nt, artificial sequence
  siRNA Sense Sequence
guggccuugucuccuucua

SEQ ID NO: 4364 - RNA, 19 nt, artificial sequence
  siRNA Antisense Sequence
uagaaggagacaaggccac

SEQ ID NO: 4365 - RNA, 19 nt, artificial sequence
  siRNA Sense Sequence
cuugucuccuucuaccggg

SEQ ID NO: 4366 - RNA, 19 nt, artificial sequence
  siRNA Antisense Sequence
cccgguagaaggagacaag

SEQ ID NO: 4367 - RNA, 19 nt, artificial sequence
  siRNA Sense Sequence
uugucuccuucuaccggga

SEQ ID NO: 4368 - RNA, 19 nt, artificial sequence
  siRNA Antisense Sequence
ucccgguagaaggagacaa

SEQ ID NO: 4369 - RNA, 19 nt, artificial sequence
  siRNA Sense Sequence
ugucuccuucuaccgggac

SEQ ID NO: 4370 - RNA, 19 nt, artificial sequence
  siRNA Antisense Sequence
gucccgguagaaggagaca

SEQ ID NO: 4371 - RNA, 19 nt, artificial sequence
  siRNA Sense Sequence
gucuccuucuaccgggacu

SEQ ID NO: 4372 - RNA, 19 nt, artificial sequence
  siRNA Antisense Sequence
agucccgguagaaggagac

SEQ ID NO: 4373 - RNA, 19 nt, artificial sequence
  siRNA Sense Sequence
uucuaccgggacuggaagc

SEQ ID NO: 4374 - RNA, 19 nt, artificial sequence
  siRNA Antisense Sequence
gcuuccagucccgguagaa

SEQ ID NO: 4375 - RNA, 19 nt, artificial sequence
  siRNA Sense Sequence
ucuaccgggacuggaagca

SEQ ID NO: 4376 - RNA, 19 nt, artificial sequence
  siRNA Antisense Sequence
ugcuuccagucccgguaga

SEQ ID NO: 4377 - RNA, 19 nt, artificial sequence
  siRNA Sense Sequence
cuaccgggacuggaagcag

SEQ ID NO: 4378 - RNA, 19 nt, artificial sequence
  siRNA Antisense Sequence
cugcuuccagucccgguag

SEQ ID NO: 4379 - RNA, 19 nt, artificial sequence
  siRNA Sense Sequence
agcagggcuuuggcagcau

SEQ ID NO: 4380 - RNA, 19 nt, artificial sequence
  siRNA Antisense Sequence
augcugccaaagcccugcu

SEQ ID NO: 4381 - RNA, 19 nt, artificial sequence
  siRNA Sense Sequence
agggcuuuggcagcauccg

SEQ ID NO: 4382 - RNA, 19 nt, artificial sequence
  siRNA Antisense Sequence
cggaugcugccaaagcccu

SEQ ID NO: 4383 - RNA, 19 nt, artificial sequence
  siRNA Sense Sequence
gggcuuuggcagcauccgu

SEQ ID NO: 4384 - RNA, 19 nt, artificial sequence
  siRNA Antisense Sequence
acggaugcugccaaagccc

SEQ ID NO: 4385 - RNA, 19 nt, artificial sequence
  siRNA Sense Sequence
ggcuuuggcagcauccgug

SEQ ID NO: 4386 - RNA, 19 nt, artificial sequence
  siRNA Antisense Sequence
cacggaugcugccaaagcc

SEQ ID NO: 4387 - RNA, 19 nt, artificial sequence
  siRNA Sense Sequence
cauccaccggcucuccaga

SEQ ID NO: 4388 - RNA, 19 nt, artificial sequence
  siRNA Antisense Sequence
ucuggagagccgguggaug

SEQ ID NO: 4389 - RNA, 19 nt, artificial sequence
  siRNA Sense Sequence
auccaccggcucuccagac

SEQ ID NO: 4390 - RNA, 19 nt, artificial sequence
  siRNA Antisense Sequence
gucuggagagccgguggau

SEQ ID NO: 4391 - RNA, 19 nt, artificial sequence
  siRNA Sense Sequence
uccaccggcucuccagaca

SEQ ID NO: 4392 - RNA, 19 nt, artificial sequence
  siRNA Antisense Sequence
ugucuggagagccggugga

SEQ ID NO: 4393 - RNA, 19 nt, artificial sequence
  siRNA Sense Sequence
cuggaccagugccaccaca

SEQ ID NO: 4394 - RNA, 19 nt, artificial sequence
  siRNA Antisense Sequence
ugugguggcacugguccag

SEQ ID NO: 4395 - RNA, 19 nt, artificial sequence
  siRNA Sense Sequence
gggugccauuccuauucug

SEQ ID NO: 4396 - RNA, 19 nt, artificial sequence
  siRNA Antisense Sequence
cagaauaggaauggcaccc

SEQ ID NO: 4397 - RNA, 19 nt, artificial sequence
  siRNA Sense Sequence
ggugccauuccuauucuga

SEQ ID NO: 4398 - RNA, 19 nt, artificial sequence
  siRNA Antisense Sequence
ucagaauaggaauggcacc

SEQ ID NO: 4399 - RNA, 19 nt, artificial sequence
  siRNA Sense Sequence
gugccauuccuauucugau

SEQ ID NO: 4400 - RNA, 19 nt, artificial sequence
  siRNA Antisense Sequence
aucagaauaggaauggcac

SEQ ID NO: 4401 - RNA, 19 nt, artificial sequence
  siRNA Sense Sequence
ugccauuccuauucugauu

SEQ ID NO: 4402 - RNA, 19 nt, artificial sequence
  siRNA Antisense Sequence
aaucagaauaggaauggca

SEQ ID NO: 4403 - RNA, 19 nt, artificial sequence
  siRNA Sense Sequence
auuccuauucugauucaag

SEQ ID NO: 4404 - RNA, 19 nt, artificial sequence
  siRNA Antisense Sequence
cuugaaucagaauaggaau

SEQ ID NO: 4405 - RNA, 19 nt, artificial sequence
  siRNA Sense Sequence
uguauauucauugugaugg

SEQ ID NO: 4406 - RNA, 19 nt, artificial sequence
  siRNA Antisense Sequence
ccaucacaaugaauauaca

SEQ ID NO: 4407 - RNA, 19 nt, artificial sequence
  siRNA Sense Sequence
guauauucauugugauggu

SEQ ID NO: 4408 - RNA, 19 nt, artificial sequence
  siRNA Antisense Sequence
accaucacaaugaauauac

SEQ ID NO: 4409 - RNA, 19 nt, artificial sequence
  siRNA Sense Sequence
auucauugugaugguuuuc

SEQ ID NO: 4410 - RNA, 19 nt, artificial sequence
  siRNA Antisense Sequence
gaaaaccaucacaaugaau

SEQ ID NO: 4411 - RNA, 19 nt, artificial sequence
  siRNA Sense Sequence
uucauugugaugguuuucc

SEQ ID NO: 4412 - RNA, 19 nt, artificial sequence
  siRNA Antisense Sequence
ggaaaaccaucacaaugaa

SEQ ID NO: 4413 - RNA, 19 nt, artificial sequence
  siRNA Sense Sequence
ugugaugguuuuccugcaa

SEQ ID NO: 4414 - RNA, 19 nt, artificial sequence
  siRNA Antisense Sequence
uugcaggaaaaccaucaca

SEQ ID NO: 4415 - RNA, 19 nt, artificial sequence
  siRNA Sense Sequence
gugaugguuuuccugcaag

SEQ ID NO: 4416 - RNA, 19 nt, artificial sequence
  siRNA Antisense Sequence
cuugcaggaaaaccaucac

SEQ ID NO: 4417 - RNA, 19 nt, artificial sequence
  siRNA Sense Sequence
ugaugguuuuccugcaagu

SEQ ID NO: 4418 - RNA, 19 nt, artificial sequence
  siRNA Antisense Sequence
acuugcaggaaaaccauca

SEQ ID NO: 4419 - RNA, 19 nt, artificial sequence
  siRNA Sense Sequence
augguuuuccugcaaguug

SEQ ID NO: 4420 - RNA, 19 nt, artificial sequence
  siRNA Antisense Sequence
caacuugcaggaaaaccau

SEQ ID NO: 4421 - RNA, 19 nt, artificial sequence
  siRNA Sense Sequence
gguuuuccugcaaguugua

SEQ ID NO: 4422 - RNA, 19 nt, artificial sequence
  siRNA Antisense Sequence
uacaacuugcaggaaaacc

SEQ ID NO: 4423 - RNA, 19 nt, artificial sequence
  siRNA Sense Sequence
guuuuccugcaaguuguaa

SEQ ID NO: 4424 - RNA, 19 nt, artificial sequence
  siRNA Antisense Sequence
uuacaacuugcaggaaaac

SEQ ID NO: 4425 - RNA, 19 nt, artificial sequence
  siRNA Sense Sequence
uuuuccugcaaguuguaau

SEQ ID NO: 4426 - RNA, 19 nt, artificial sequence
  siRNA Antisense Sequence
auuacaacuugcaggaaaa

SEQ ID NO: 4427 - RNA, 19 nt, artificial sequence
  siRNA Sense Sequence
uuuccugcaaguuguaaug

SEQ ID NO: 4428 - RNA, 19 nt, artificial sequence
  siRNA Antisense Sequence
cauuacaacuugcaggaaa

SEQ ID NO: 4429 - RNA, 19 nt, artificial sequence
  siRNA Sense Sequence
uuccugcaaguuguaaugg

SEQ ID NO: 4430 - RNA, 19 nt, artificial sequence
  siRNA Antisense Sequence
ccauuacaacuugcaggaa

SEQ ID NO: 4431 - RNA, 19 nt, artificial sequence
  siRNA Sense Sequence
uccugcaaguuguaaugga

SEQ ID NO: 4432 - RNA, 19 nt, artificial sequence
  siRNA Antisense Sequence
uccauuacaacuugcagga

SEQ ID NO: 4433 - RNA, 19 nt, artificial sequence
  siRNA Sense Sequence
caaguuguaauggaguuga

SEQ ID NO: 4434 - RNA, 19 nt, artificial sequence
  siRNA Antisense Sequence
ucaacuccauuacaacuug

SEQ ID NO: 4435 - RNA, 19 nt, artificial sequence
  siRNA Sense Sequence
aaguuguaauggaguugag

SEQ ID NO: 4436 - RNA, 19 nt, artificial sequence
  siRNA Antisense Sequence
cucaacuccauuacaacuu

SEQ ID NO: 4437 - RNA, 19 nt, artificial sequence
  siRNA Sense Sequence
aguuguaauggaguugagg

SEQ ID NO: 4438 - RNA, 19 nt, artificial sequence
  siRNA Antisense Sequence
ccucaacuccauuacaacu

SEQ ID NO: 4439 - RNA, 19 nt, artificial sequence
  siRNA Sense Sequence
guuguaauggaguugagga

SEQ ID NO: 4440 - RNA, 19 nt, artificial sequence
  siRNA Antisense Sequence
uccucaacuccauuacaac

SEQ ID NO: 4441 - RNA, 19 nt, artificial sequence
  siRNA Sense Sequence
cugcaggugggacaggaag

SEQ ID NO: 4442 - RNA, 19 nt, artificial sequence
  siRNA Antisense Sequence
cuuccugucccaccugcag

SEQ ID NO: 4443 - RNA, 19 nt, artificial sequence
  siRNA Sense Sequence
gcaggugggacaggaagag

SEQ ID NO: 4444 - RNA, 19 nt, artificial sequence
  siRNA Antisense Sequence
cucuuccugucccaccugc

SEQ ID NO: 4445 - RNA, 19 nt, artificial sequence
  siRNA Sense Sequence
caggugggacaggaagagg

SEQ ID NO: 4446 - RNA, 19 nt, artificial sequence
  siRNA Antisense Sequence
ccucuuccugucccaccug

SEQ ID NO: 4447 - RNA, 19 nt, artificial sequence
  siRNA Sense Sequence
aggugggacaggaagaggc

SEQ ID NO: 4448 - RNA, 19 nt, artificial sequence
  siRNA Antisense Sequence
gccucuuccugucccaccu

SEQ ID NO: 4449 - RNA, 19 nt, artificial sequence
  siRNA Sense Sequence
gggacaggaagaggccaga

SEQ ID NO: 4450 - RNA, 19 nt, artificial sequence
  siRNA Antisense Sequence
ucuggccucuuccuguccc

SEQ ID NO: 4451 - RNA, 19 nt, artificial sequence
  siRNA Sense Sequence
ggacaggaagaggccagac

SEQ ID NO: 4452 - RNA, 19 nt, artificial sequence
  siRNA Antisense Sequence
gucuggccucuuccugucc

SEQ ID NO: 4453 - RNA, 19 nt, artificial sequence
  siRNA Sense Sequence
gacaggaagaggccagacc

SEQ ID NO: 4454 - RNA, 19 nt, artificial sequence
  siRNA Antisense Sequence
ggucuggccucuuccuguc

SEQ ID NO: 4455 - RNA, 19 nt, artificial sequence
  siRNA Sense Sequence
cagacccaggccagaguag

SEQ ID NO: 4456 - RNA, 19 nt, artificial sequence
  siRNA Antisense Sequence
cuacucuggccugggucug

SEQ ID NO: 4457 - RNA, 19 nt, artificial sequence
  siRNA Sense Sequence
agacccaggccagaguaga

SEQ ID NO: 4458 - RNA, 19 nt, artificial sequence
  siRNA Antisense Sequence
ucuacucuggccugggucu

SEQ ID NO: 4459 - RNA, 19 nt, artificial sequence
  siRNA Sense Sequence
gacccaggccagaguagag

SEQ ID NO: 4460 - RNA, 19 nt, artificial sequence
  siRNA Antisense Sequence
cucuacucuggccuggguc

SEQ ID NO: 4461 - RNA, 19 nt, artificial sequence
  siRNA Sense Sequence
cccaggccagaguagagca

SEQ ID NO: 4462 - RNA, 19 nt, artificial sequence
  siRNA Antisense Sequence
ugcucuacucuggccuggg

SEQ ID NO: 4463 - RNA, 19 nt, artificial sequence
  siRNA Sense Sequence
caggccagaguagagcaaa

SEQ ID NO: 4464 - RNA, 19 nt, artificial sequence
  siRNA Antisense Sequence
uuugcucuacucuggccug

SEQ ID NO: 4465 - RNA, 19 nt, artificial sequence
  siRNA Sense Sequence
gccagaguagagcaaauuc

SEQ ID NO: 4466 - RNA, 19 nt, artificial sequence
  siRNA Antisense Sequence
gaauuugcucuacucuggc

SEQ ID NO: 4467 - RNA, 19 nt, artificial sequence
  siRNA Sense Sequence
ccagaguagagcaaauuca

SEQ ID NO: 4468 - RNA, 19 nt, artificial sequence
  siRNA Antisense Sequence
ugaauuugcucuacucugg

SEQ ID NO: 4469 - RNA, 19 nt, artificial sequence
  siRNA Sense Sequence
cagaguagagcaaauucaa

SEQ ID NO: 4470 - RNA, 19 nt, artificial sequence
  siRNA Antisense Sequence
uugaauuugcucuacucug

SEQ ID NO: 4471 - RNA, 19 nt, artificial sequence
  siRNA Sense Sequence
agaguagagcaaauucaac

SEQ ID NO: 4472 - RNA, 19 nt, artificial sequence
  siRNA Antisense Sequence
guugaauuugcucuacucu

SEQ ID NO: 4473 - RNA, 19 nt, artificial sequence
  siRNA Sense Sequence
acacuagucucugcucugg

SEQ ID NO: 4474 - RNA, 19 nt, artificial sequence
  siRNA Antisense Sequence
ccagagcagagacuagugu

SEQ ID NO: 4475 - RNA, 19 nt, artificial sequence
  siRNA Sense Sequence
cacuagucucugcucuggc

SEQ ID NO: 4476 - RNA, 19 nt, artificial sequence
  siRNA Antisense Sequence
gccagagcagagacuagug

SEQ ID NO: 4477 - RNA, 19 nt, artificial sequence
  siRNA Sense Sequence
cuagucucugcucuggccg

SEQ ID NO: 4478 - RNA, 19 nt, artificial sequence
  siRNA Antisense Sequence
cggccagagcagagacuag

SEQ ID NO: 4479 - RNA, 19 nt, artificial sequence
  siRNA Sense Sequence
uagucucugcucuggccga

SEQ ID NO: 4480 - RNA, 19 nt, artificial sequence
  siRNA Antisense Sequence
ucggccagagcagagacua

SEQ ID NO: 4481 - RNA, 19 nt, artificial sequence
  siRNA Sense Sequence
agucucugcucuggccgag

SEQ ID NO: 4482 - RNA, 19 nt, artificial sequence
  siRNA Antisense Sequence
cucggccagagcagagacu

SEQ ID NO: 4483 - RNA, 19 nt, artificial sequence
  siRNA Sense Sequence
cucuggccgagcaugaggu

SEQ ID NO: 4484 - RNA, 19 nt, artificial sequence
  siRNA Antisense Sequence
accucaugcucggccagag

SEQ ID NO: 4485 - RNA, 19 nt, artificial sequence
  siRNA Sense Sequence
ucuggccgagcaugagguc

SEQ ID NO: 4486 - RNA, 19 nt, artificial sequence
  siRNA Antisense Sequence
gaccucaugcucggccaga

SEQ ID NO: 4487 - RNA, 19 nt, artificial sequence
  siRNA Sense Sequence
uggccgagcaugagguccu

SEQ ID NO: 4488 - RNA, 19 nt, artificial sequence
  siRNA Antisense Sequence
aggaccucaugcucggcca

SEQ ID NO: 4489 - RNA, 19 nt, artificial sequence
  siRNA Sense Sequence
ggccgagcaugagguccuu

SEQ ID NO: 4490 - RNA, 19 nt, artificial sequence
  siRNA Antisense Sequence
aaggaccucaugcucggcc

SEQ ID NO: 4491 - RNA, 19 nt, artificial sequence
  siRNA Sense Sequence
gccgagcaugagguccuuu

SEQ ID NO: 4492 - RNA, 19 nt, artificial sequence
  siRNA Antisense Sequence
aaaggaccucaugcucggc

SEQ ID NO: 4493 - RNA, 19 nt, artificial sequence
  siRNA Sense Sequence
ccgagcaugagguccuuua

SEQ ID NO: 4494 - RNA, 19 nt, artificial sequence
  siRNA Antisense Sequence
uaaaggaccucaugcucgg

SEQ ID NO: 4495 - RNA, 19 nt, artificial sequence
  siRNA Sense Sequence
cgagcaugagguccuuuag

SEQ ID NO: 4496 - RNA, 19 nt, artificial sequence
  siRNA Antisense Sequence
cuaaaggaccucaugcucg

SEQ ID NO: 4497 - RNA, 19 nt, artificial sequence
  siRNA Sense Sequence
gagcaugagguccuuuagg

SEQ ID NO: 4498 - RNA, 19 nt, artificial sequence
  siRNA Antisense Sequence
ccuaaaggaccucaugcuc

SEQ ID NO: 4499 - RNA, 19 nt, artificial sequence
  siRNA Sense Sequence
agcaugagguccuuuaggu

SEQ ID NO: 4500 - RNA, 19 nt, artificial sequence
  siRNA Antisense Sequence
accuaaaggaccucaugcu

SEQ ID NO: 4501 - RNA, 19 nt, artificial sequence
  siRNA Sense Sequence
gcaugagguccuuuaggug

SEQ ID NO: 4502 - RNA, 19 nt, artificial sequence
  siRNA Antisense Sequence
caccuaaaggaccucaugc

SEQ ID NO: 4503 - RNA, 19 nt, artificial sequence
  siRNA Sense Sequence
caugagguccuuuaggugc

SEQ ID NO: 4504 - RNA, 19 nt, artificial sequence
  siRNA Antisense Sequence
gcaccuaaaggaccucaug

SEQ ID NO: 4505 - RNA, 19 nt, artificial sequence
  siRNA Sense Sequence
augagguccuuuaggugca

SEQ ID NO: 4506 - RNA, 19 nt, artificial sequence
  siRNA Antisense Sequence
ugcaccuaaaggaccucau

SEQ ID NO: 4507 - RNA, 19 nt, artificial sequence
  siRNA Sense Sequence
ugagguccuuuaggugcaa

SEQ ID NO: 4508 - RNA, 19 nt, artificial sequence
  siRNA Antisense Sequence
uugcaccuaaaggaccuca

SEQ ID NO: 4509 - RNA, 19 nt, artificial sequence
  siRNA Sense Sequence
gagguccuuuaggugcaaa

SEQ ID NO: 4510 - RNA, 19 nt, artificial sequence
  siRNA Antisense Sequence
uuugcaccuaaaggaccuc

SEQ ID NO: 4511 - RNA, 19 nt, artificial sequence
  siRNA Sense Sequence
agguccuuuaggugcaaau

SEQ ID NO: 4512 - RNA, 19 nt, artificial sequence
  siRNA Antisense Sequence
auuugcaccuaaaggaccu

SEQ ID NO: 4513 - RNA, 19 nt, artificial sequence
  siRNA Sense Sequence
gguccuuuaggugcaaauc

SEQ ID NO: 4514 - RNA, 19 nt, artificial sequence
  siRNA Antisense Sequence
gauuugcaccuaaaggacc

SEQ ID NO: 4515 - RNA, 19 nt, artificial sequence
  siRNA Sense Sequence
guccuuuaggugcaaaucu

SEQ ID NO: 4516 - RNA, 19 nt, artificial sequence
  siRNA Antisense Sequence
agauuugcaccuaaaggac

SEQ ID NO: 4517 - RNA, 19 nt, artificial sequence
  siRNA Sense Sequence
uccuuuaggugcaaaucuu

SEQ ID NO: 4518 - RNA, 19 nt, artificial sequence
  siRNA Antisense Sequence
aagauuugcaccuaaagga

SEQ ID NO: 4519 - RNA, 19 nt, artificial sequence
  siRNA Sense Sequence
ccuuuaggugcaaaucuua

SEQ ID NO: 4520 - RNA, 19 nt, artificial sequence
  siRNA Antisense Sequence
uaagauuugcaccuaaagg

SEQ ID NO: 4521 - RNA, 19 nt, artificial sequence
  siRNA Sense Sequence
cuuuaggugcaaaucuuac

SEQ ID NO: 4522 - RNA, 19 nt, artificial sequence
  siRNA Antisense Sequence
guaagauuugcaccuaaag

SEQ ID NO: 4523 - RNA, 19 nt, artificial sequence
  siRNA Sense Sequence
uuuaggugcaaaucuuacu

SEQ ID NO: 4524 - RNA, 19 nt, artificial sequence
  siRNA Antisense Sequence
aguaagauuugcaccuaaa

SEQ ID NO: 4525 - RNA, 19 nt, artificial sequence
  siRNA Sense Sequence
gcaaaucuuacugauacug

SEQ ID NO: 4526 - RNA, 19 nt, artificial sequence
  siRNA Antisense Sequence
caguaucaguaagauuugc

SEQ ID NO: 4527 - RNA, 19 nt, artificial sequence
  siRNA Sense Sequence
ucuuacugauacuguuugg

SEQ ID NO: 4528 - RNA, 19 nt, artificial sequence
  siRNA Antisense Sequence
ccaaacaguaucaguaaga

SEQ ID NO: 4529 - RNA, 19 nt, artificial sequence
  siRNA Sense Sequence
aaagcacucacuauauccu

SEQ ID NO: 4530 - RNA, 19 nt, artificial sequence
  siRNA Antisense Sequence
aggauauagugagugcuuu

SEQ ID NO: 4531 - RNA, 19 nt, artificial sequence
  siRNA Sense Sequence
aagcacucacuauauccuc

SEQ ID NO: 4532 - RNA, 19 nt, artificial sequence
  siRNA Antisense Sequence
gaggauauagugagugcuu

SEQ ID NO: 4533 - RNA, 19 nt, artificial sequence
  siRNA Sense Sequence
acucacuauauccucaugu

SEQ ID NO: 4534 - RNA, 19 nt, artificial sequence
  siRNA Antisense Sequence
acaugaggauauagugagu

SEQ ID NO: 4535 - RNA, 19 nt, artificial sequence
  siRNA Sense Sequence
ucacuauauccucauguuu

SEQ ID NO: 4536 - RNA, 19 nt, artificial sequence
  siRNA Antisense Sequence
aaacaugaggauauaguga

SEQ ID NO: 4537 - RNA, 19 nt, artificial sequence
  siRNA Sense Sequence
uauccucauguuucucuua

SEQ ID NO: 4538 - RNA, 19 nt, artificial sequence
  siRNA Antisense Sequence
uaagagaaacaugaggaua

SEQ ID NO: 4539 - RNA, 19 nt, artificial sequence
  siRNA Sense Sequence
auccucauguuucucuuac

SEQ ID NO: 4540 - RNA, 19 nt, artificial sequence
  siRNA Antisense Sequence
guaagagaaacaugaggau

SEQ ID NO: 4541 - RNA, 19 nt, artificial sequence
  siRNA Sense Sequence
uccucauguuucucuuaca

SEQ ID NO: 4542 - RNA, 19 nt, artificial sequence
  siRNA Antisense Sequence
uguaagagaaacaugagga

SEQ ID NO: 4543 - RNA, 19 nt, artificial sequence
  siRNA Sense Sequence
cucauguuucucuuacagc

SEQ ID NO: 4544 - RNA, 19 nt, artificial sequence
  siRNA Antisense Sequence
gcuguaagagaaacaugag

SEQ ID NO: 4545 - RNA, 19 nt, artificial sequence
  siRNA Sense Sequence
ucauguuucucuuacagca

SEQ ID NO: 4546 - RNA, 19 nt, artificial sequence
  siRNA Antisense Sequence
ugcuguaagagaaacauga

SEQ ID NO: 4547 - RNA, 19 nt, artificial sequence
  siRNA Sense Sequence
uucucuuacagcagcucug

SEQ ID NO: 4548 - RNA, 19 nt, artificial sequence
  siRNA Antisense Sequence
cagagcugcuguaagagaa

SEQ ID NO: 4549 - RNA, 19 nt, artificial sequence
  siRNA Sense Sequence
gcagcucugugugggauuc

SEQ ID NO: 4550 - RNA, 19 nt, artificial sequence
  siRNA Antisense Sequence
gaaucccacacagagcugc

SEQ ID NO: 4551 - RNA, 19 nt, artificial sequence
  siRNA Sense Sequence
acauagcugcaccuuauaa

SEQ ID NO: 4552 - RNA, 19 nt, artificial sequence
  siRNA Antisense Sequence
uuauaaggugcagcuaugu

SEQ ID NO: 4553 - RNA, 19 nt, artificial sequence
  siRNA Sense Sequence
cauagcugcaccuuauaag

SEQ ID NO: 4554 - RNA, 19 nt, artificial sequence
  siRNA Antisense Sequence
cuuauaaggugcagcuaug

SEQ ID NO: 4555 - RNA, 19 nt, artificial sequence
  siRNA Sense Sequence
auagcugcaccuuauaagc

SEQ ID NO: 4556 - RNA, 19 nt, artificial sequence
  siRNA Antisense Sequence
gcuuauaaggugcagcuau

SEQ ID NO: 4557 - RNA, 19 nt, artificial sequence
  siRNA Sense Sequence
uagcugcaccuuauaagca

SEQ ID NO: 4558 - RNA, 19 nt, artificial sequence
  siRNA Antisense Sequence
ugcuuauaaggugcagcua

SEQ ID NO: 4559 - RNA, 19 nt, artificial sequence
  siRNA Sense Sequence
agacuaaucaaggccauau

SEQ ID NO: 4560 - RNA, 19 nt, artificial sequence
  siRNA Antisense Sequence
auauggccuugauuagucu

SEQ ID NO: 4561 - RNA, 19 nt, artificial sequence
  siRNA Sense Sequence
gacuaaucaaggccauaug

SEQ ID NO: 4562 - RNA, 19 nt, artificial sequence
  siRNA Antisense Sequence
cauauggccuugauuaguc

SEQ ID NO: 4563 - RNA, 19 nt, artificial sequence
  siRNA Sense Sequence
acuaaucaaggccauaugg

SEQ ID NO: 4564 - RNA, 19 nt, artificial sequence
  siRNA Antisense Sequence
ccauauggccuugauuagu

SEQ ID NO: 4565 - RNA, 19 nt, artificial sequence
  siRNA Sense Sequence
cuaaucaaggccauauggu

SEQ ID NO: 4566 - RNA, 19 nt, artificial sequence
  siRNA Antisense Sequence
accauauggccuugauuag

SEQ ID NO: 4567 - RNA, 19 nt, artificial sequence
  siRNA Sense Sequence
uaaucaaggccauauggug

SEQ ID NO: 4568 - RNA, 19 nt, artificial sequence
  siRNA Antisense Sequence
caccauauggccuugauua

SEQ ID NO: 4569 - RNA, 19 nt, artificial sequence
  siRNA Sense Sequence
aaucaaggccauaugguga

SEQ ID NO: 4570 - RNA, 19 nt, artificial sequence
  siRNA Antisense Sequence
ucaccauauggccuugauu

SEQ ID NO: 4571 - RNA, 19 nt, artificial sequence
  siRNA Sense Sequence
aucaaggccauauggugaa

SEQ ID NO: 4572 - RNA, 19 nt, artificial sequence
  siRNA Antisense Sequence
uucaccauauggccuugau

SEQ ID NO: 4573 - RNA, 19 nt, artificial sequence
  siRNA Sense Sequence
ucaaggccauauggugaau

SEQ ID NO: 4574 - RNA, 19 nt, artificial sequence
  siRNA Antisense Sequence
auucaccauauggccuuga

SEQ ID NO: 4575 - RNA, 19 nt, artificial sequence
  siRNA Sense Sequence
caaggccauauggugaauc

SEQ ID NO: 4576 - RNA, 19 nt, artificial sequence
  siRNA Antisense Sequence
gauucaccauauggccuug

SEQ ID NO: 4577 - RNA, 19 nt, artificial sequence
  siRNA Sense Sequence
aaggccauauggugaauca

SEQ ID NO: 4578 - RNA, 19 nt, artificial sequence
  siRNA Antisense Sequence
ugauucaccauauggccuu

SEQ ID NO: 4579 - RNA, 19 nt, artificial sequence
  siRNA Sense Sequence
aaagaaguucgagccuugu

SEQ ID NO: 4580 - RNA, 19 nt, artificial sequence
  siRNA Antisense Sequence
acaaggcucgaacuucuuu

SEQ ID NO: 4581 - RNA, 19 nt, artificial sequence
  siRNA Sense Sequence
aagaaguucgagccuuguu

SEQ ID NO: 4582 - RNA, 19 nt, artificial sequence
  siRNA Antisense Sequence
aacaaggcucgaacuucuu

SEQ ID NO: 4583 - RNA, 19 nt, artificial sequence
  siRNA Sense Sequence
agaaguucgagccuuguuu

SEQ ID NO: 4584 - RNA, 19 nt, artificial sequence
  siRNA Antisense Sequence
aaacaaggcucgaacuucu

SEQ ID NO: 4585 - RNA, 19 nt, artificial sequence
  siRNA Sense Sequence
gaaguucgagccuuguuuu

SEQ ID NO: 4586 - RNA, 19 nt, artificial sequence
  siRNA Antisense Sequence
aaaacaaggcucgaacuuc

SEQ ID NO: 4587 - RNA, 19 nt, artificial sequence
  siRNA Sense Sequence
aaguucgagccuuguuuuc

SEQ ID NO: 4588 - RNA, 19 nt, artificial sequence
  siRNA Antisense Sequence
gaaaacaaggcucgaacuu

SEQ ID NO: 4589 - RNA, 19 nt, artificial sequence
  siRNA Sense Sequence
aguucgagccuuguuuucu

SEQ ID NO: 4590 - RNA, 19 nt, artificial sequence
  siRNA Antisense Sequence
agaaaacaaggcucgaacu

SEQ ID NO: 4591 - RNA, 19 nt, artificial sequence
  siRNA Sense Sequence
guucgagccuuguuuucug

SEQ ID NO: 4592 - RNA, 19 nt, artificial sequence
  siRNA Antisense Sequence
cagaaaacaaggcucgaac

SEQ ID NO: 4593 - RNA, 19 nt, artificial sequence
  siRNA Sense Sequence
uucgagccuuguuuucuga

SEQ ID NO: 4594 - RNA, 19 nt, artificial sequence
  siRNA Antisense Sequence
ucagaaaacaaggcucgaa

SEQ ID NO: 4595 - RNA, 19 nt, artificial sequence
  siRNA Sense Sequence
ucgagccuuguuuucugau

SEQ ID NO: 4596 - RNA, 19 nt, artificial sequence
  siRNA Antisense Sequence
aucagaaaacaaggcucga

SEQ ID NO: 4597 - RNA, 19 nt, artificial sequence
  siRNA Sense Sequence
cgagccuuguuuucugauu

SEQ ID NO: 4598 - RNA, 19 nt, artificial sequence
  siRNA Antisense Sequence
aaucagaaaacaaggcucg

SEQ ID NO: 4599 - RNA, 19 nt, artificial sequence
  siRNA Sense Sequence
uucugauucccagguuaac

SEQ ID NO: 4600 - RNA, 19 nt, artificial sequence
  siRNA Antisense Sequence
guuaaccugggaaucagaa

SEQ ID NO: 4601 - RNA, 19 nt, artificial sequence
  siRNA Sense Sequence
aaaagauguuuggcuaugg

SEQ ID NO: 4602 - RNA, 19 nt, artificial sequence
  siRNA Antisense Sequence
ccauagccaaacaucuuuu

SEQ ID NO: 4603 - RNA, 19 nt, artificial sequence
  siRNA Sense Sequence
aaagauguuuggcuauggg

SEQ ID NO: 4604 - RNA, 19 nt, artificial sequence
  siRNA Antisense Sequence
cccauagccaaacaucuuu

SEQ ID NO: 4605 - RNA, 19 nt, artificial sequence
  siRNA Sense Sequence
aagauguuuggcuauggga

SEQ ID NO: 4606 - RNA, 19 nt, artificial sequence
  siRNA Antisense Sequence
ucccauagccaaacaucuu

SEQ ID NO: 4607 - RNA, 19 nt, artificial sequence
  siRNA Sense Sequence
agauguuuggcuaugggac

SEQ ID NO: 4608 - RNA, 19 nt, artificial sequence
  siRNA Antisense Sequence
gucccauagccaaacaucu

SEQ ID NO: 4609 - RNA, 19 nt, artificial sequence
  siRNA Sense Sequence
gauguuuggcuaugggacu

SEQ ID NO: 4610 - RNA, 19 nt, artificial sequence
  siRNA Antisense Sequence
agucccauagccaaacauc

SEQ ID NO: 4611 - RNA, 19 nt, artificial sequence
  siRNA Sense Sequence
uuuggcuaugggacuguca

SEQ ID NO: 4612 - RNA, 19 nt, artificial sequence
  siRNA Antisense Sequence
ugacagucccauagccaaa

SEQ ID NO: 4613 - RNA, 19 nt, artificial sequence
  siRNA Sense Sequence
uuggcuaugggacugucag

SEQ ID NO: 4614 - RNA, 19 nt, artificial sequence
  siRNA Antisense Sequence
cugacagucccauagccaa

SEQ ID NO: 4615 - RNA, 19 nt, artificial sequence
  siRNA Sense Sequence
uggcuaugggacugucagg

SEQ ID NO: 4616 - RNA, 19 nt, artificial sequence
  siRNA Antisense Sequence
ccugacagucccauagcca

SEQ ID NO: 4617 - RNA, 19 nt, artificial sequence
  siRNA Sense Sequence
gagccugcugcacuuucuu

SEQ ID NO: 4618 - RNA, 19 nt, artificial sequence
  siRNA Antisense Sequence
aagaaagugcagcaggcuc

SEQ ID NO: 4619 - RNA, 19 nt, artificial sequence
  siRNA Sense Sequence
cugcugcacuuucuuuaag

SEQ ID NO: 4620 - RNA, 19 nt, artificial sequence
  siRNA Antisense Sequence
cuuaaagaaagugcagcag

SEQ ID NO: 4621 - RNA, 19 nt, artificial sequence
  siRNA Sense Sequence
ugcugcacuuucuuuaagg

SEQ ID NO: 4622 - RNA, 19 nt, artificial sequence
  siRNA Antisense Sequence
ccuuaaagaaagugcagca

SEQ ID NO: 4623 - RNA, 19 nt, artificial sequence
  siRNA Sense Sequence
gcugcacuuucuuuaaggc

SEQ ID NO: 4624 - RNA, 19 nt, artificial sequence
  siRNA Antisense Sequence
gccuuaaagaaagugcagc

SEQ ID NO: 4625 - RNA, 19 nt, artificial sequence
  siRNA Sense Sequence
ugcacuuucuuuaaggcuc

SEQ ID NO: 4626 - RNA, 19 nt, artificial sequence
  siRNA Antisense Sequence
gagccuuaaagaaagugca

SEQ ID NO: 4627 - RNA, 19 nt, artificial sequence
  siRNA Sense Sequence
gcacuuucuuuaaggcucu

SEQ ID NO: 4628 - RNA, 19 nt, artificial sequence
  siRNA Antisense Sequence
agagccuuaaagaaagugc

SEQ ID NO: 4629 - RNA, 19 nt, artificial sequence
  siRNA Sense Sequence
cacuuucuuuaaggcucug

SEQ ID NO: 4630 - RNA, 19 nt, artificial sequence
  siRNA Antisense Sequence
cagagccuuaaagaaagug

SEQ ID NO: 4631 - RNA, 19 nt, artificial sequence
  siRNA Sense Sequence
uucuuuaaggcucugcucc

SEQ ID NO: 4632 - RNA, 19 nt, artificial sequence
  siRNA Antisense Sequence
ggagcagagccuuaaagaa

SEQ ID NO: 4633 - RNA, 19 nt, artificial sequence
  siRNA Sense Sequence
gcucugcuccuccugacag

SEQ ID NO: 4634 - RNA, 19 nt, artificial sequence
  siRNA Antisense Sequence
cugucaggaggagcagagc

SEQ ID NO: 4635 - RNA, 19 nt, artificial sequence
  siRNA Sense Sequence
aggacugggagggcaaccu

SEQ ID NO: 4636 - RNA, 19 nt, artificial sequence
  siRNA Antisense Sequence
agguugcccucccaguccu

SEQ ID NO: 4637 - RNA, 19 nt, artificial sequence
  siRNA Sense Sequence
gcaaccugcgcuacgcuga

SEQ ID NO: 4638 - RNA, 19 nt, artificial sequence
  siRNA Antisense Sequence
ucagcguagcgcagguugc

SEQ ID NO: 4639 - RNA, 19 nt, artificial sequence
  siRNA Sense Sequence
caaccugcgcuacgcugag

SEQ ID NO: 4640 - RNA, 19 nt, artificial sequence
  siRNA Antisense Sequence
cucagcguagcgcagguug

SEQ ID NO: 4641 - RNA, 19 nt, artificial sequence
  siRNA Sense Sequence
cugcgcuacgcugaguaua

SEQ ID NO: 4642 - RNA, 19 nt, artificial sequence
  siRNA Antisense Sequence
uauacucagcguagcgcag

SEQ ID NO: 4643 - RNA, 19 nt, artificial sequence
  siRNA Sense Sequence
ugcgcuacgcugaguauag

SEQ ID NO: 4644 - RNA, 19 nt, artificial sequence
  siRNA Antisense Sequence
cuauacucagcguagcgca

SEQ ID NO: 4645 - RNA, 19 nt, artificial sequence
  siRNA Sense Sequence
cuacgcugaguauagccac

SEQ ID NO: 4646 - RNA, 19 nt, artificial sequence
  siRNA Antisense Sequence
guggcuauacucagcguag

SEQ ID NO: 4647 - RNA, 19 nt, artificial sequence
  siRNA Sense Sequence
uacgcugaguauagccacu

SEQ ID NO: 4648 - RNA, 19 nt, artificial sequence
  siRNA Antisense Sequence
aguggcuauacucagcgua

SEQ ID NO: 4649 - RNA, 19 nt, artificial sequence
  siRNA Sense Sequence
cacuuuguuuugggcaaug

SEQ ID NO: 4650 - RNA, 19 nt, artificial sequence
  siRNA Antisense Sequence
cauugcccaaaacaaagug

SEQ ID NO: 4651 - RNA, 19 nt, artificial sequence
  siRNA Sense Sequence
aacuacacuggcaaugugg

SEQ ID NO: 4652 - RNA, 19 nt, artificial sequence
  siRNA Antisense Sequence
ccacauugccaguguaguu

SEQ ID NO: 4653 - RNA, 19 nt, artificial sequence
  siRNA Sense Sequence
acuacacuggcaauguggg

SEQ ID NO: 4654 - RNA, 19 nt, artificial sequence
  siRNA Antisense Sequence
cccacauugccaguguagu

SEQ ID NO: 4655 - RNA, 19 nt, artificial sequence
  siRNA Sense Sequence
aacgacgcccuccaguauc

SEQ ID NO: 4656 - RNA, 19 nt, artificial sequence
  siRNA Antisense Sequence
gauacuggagggcgucguu

SEQ ID NO: 4657 - RNA, 19 nt, artificial sequence
  siRNA Sense Sequence
acgacgcccuccaguauca

SEQ ID NO: 4658 - RNA, 19 nt, artificial sequence
  siRNA Antisense Sequence
ugauacuggagggcgucgu

SEQ ID NO: 4659 - RNA, 19 nt, artificial sequence
  siRNA Sense Sequence
cgacgcccuccaguaucau

SEQ ID NO: 4660 - RNA, 19 nt, artificial sequence
  siRNA Antisense Sequence
augauacuggagggcgucg

SEQ ID NO: 4661 - RNA, 19 nt, artificial sequence
  siRNA Sense Sequence
gacgcccuccaguaucaua

SEQ ID NO: 4662 - RNA, 19 nt, artificial sequence
  siRNA Antisense Sequence
uaugauacuggagggcguc

SEQ ID NO: 4663 - RNA, 19 nt, artificial sequence
  siRNA Sense Sequence
acgcccuccaguaucauaa

SEQ ID NO: 4664 - RNA, 19 nt, artificial sequence
  siRNA Antisense Sequence
uuaugauacuggagggcgu

SEQ ID NO: 4665 - RNA, 19 nt, artificial sequence
  siRNA Sense Sequence
cgcccuccaguaucauaac

SEQ ID NO: 4666 - RNA, 19 nt, artificial sequence
  siRNA Antisense Sequence
guuaugauacuggagggcg

SEQ ID NO: 4667 - RNA, 19 nt, artificial sequence
  siRNA Sense Sequence
caagugugcacagcuccgc

SEQ ID NO: 4668 - RNA, 19 nt, artificial sequence
  siRNA Antisense Sequence
gcggagcugugcacacuug

SEQ ID NO: 4669 - RNA, 19 nt, artificial sequence
  siRNA Sense Sequence
aagugugcacagcuccgca

SEQ ID NO: 4670 - RNA, 19 nt, artificial sequence
  siRNA Antisense Sequence
ugcggagcugugcacacuu

SEQ ID NO: 4671 - RNA, 19 nt, artificial sequence
  siRNA Sense Sequence
agugugcacagcuccgcaa

SEQ ID NO: 4672 - RNA, 19 nt, artificial sequence
  siRNA Antisense Sequence
uugcggagcugugcacacu

SEQ ID NO: 4673 - RNA, 19 nt, artificial sequence
  siRNA Sense Sequence
ugcacagcuccgcaaaggu

SEQ ID NO: 4674 - RNA, 19 nt, artificial sequence
  siRNA Antisense Sequence
accuuugcggagcugugca

SEQ ID NO: 4675 - RNA, 19 nt, artificial sequence
  siRNA Sense Sequence
gcacagcuccgcaaaggug

SEQ ID NO: 4676 - RNA, 19 nt, artificial sequence
  siRNA Antisense Sequence
caccuuugcggagcugugc

SEQ ID NO: 4677 - RNA, 19 nt, artificial sequence
  siRNA Sense Sequence
cacagcuccgcaaagguga

SEQ ID NO: 4678 - RNA, 19 nt, artificial sequence
  siRNA Antisense Sequence
ucaccuuugcggagcugug

SEQ ID NO: 4679 - RNA, 19 nt, artificial sequence
  siRNA Sense Sequence
acagcuccgcaaaggugag

SEQ ID NO: 4680 - RNA, 19 nt, artificial sequence
  siRNA Antisense Sequence
cucaccuuugcggagcugu

SEQ ID NO: 4681 - RNA, 19 nt, artificial sequence
  siRNA Sense Sequence
caagcucauaaucccacuu

SEQ ID NO: 4682 - RNA, 19 nt, artificial sequence
  siRNA Antisense Sequence
aagugggauuaugagcuug

SEQ ID NO: 4683 - RNA, 19 nt, artificial sequence
  siRNA Sense Sequence
cauaaucccacuugaggag

SEQ ID NO: 4684 - RNA, 19 nt, artificial sequence
  siRNA Antisense Sequence
cuccucaagugggauuaug

SEQ ID NO: 4685 - RNA, 19 nt, artificial sequence
  siRNA Sense Sequence
acuguacaguugauauucc

SEQ ID NO: 4686 - RNA, 19 nt, artificial sequence
  siRNA Antisense Sequence
ggaauaucaacuguacagu

SEQ ID NO: 4687 - RNA, 19 nt, artificial sequence
  siRNA Sense Sequence
cuguacaguugauauuccg

SEQ ID NO: 4688 - RNA, 19 nt, artificial sequence
  siRNA Antisense Sequence
cggaauaucaacuguacag

SEQ ID NO: 4689 - RNA, 19 nt, artificial sequence
  siRNA Sense Sequence
uguacaguugauauuccgg

SEQ ID NO: 4690 - RNA, 19 nt, artificial sequence
  siRNA Antisense Sequence
ccggaauaucaacuguaca

SEQ ID NO: 4691 - RNA, 19 nt, artificial sequence
  siRNA Sense Sequence
guacaguugauauuccggu

SEQ ID NO: 4692 - RNA, 19 nt, artificial sequence
  siRNA Antisense Sequence
accggaauaucaacuguac

SEQ ID NO: 4693 - RNA, 19 nt, artificial sequence
  siRNA Sense Sequence
uacaguugauauuccgguu

SEQ ID NO: 4694 - RNA, 19 nt, artificial sequence
  siRNA Antisense Sequence
aaccggaauaucaacugua

SEQ ID NO: 4695 - RNA, 19 nt, artificial sequence
  siRNA Sense Sequence
acaguugauauuccgguuu

SEQ ID NO: 4696 - RNA, 19 nt, artificial sequence
  siRNA Antisense Sequence
aaaccggaauaucaacugu

SEQ ID NO: 4697 - RNA, 19 nt, artificial sequence
  siRNA Sense Sequence
caguugauauuccgguuuu

SEQ ID NO: 4698 - RNA, 19 nt, artificial sequence
  siRNA Antisense Sequence
aaaaccggaauaucaacug

SEQ ID NO: 4699 - RNA, 19 nt, artificial sequence
  siRNA Sense Sequence
aguugauauuccgguuuug

SEQ ID NO: 4700 - RNA, 19 nt, artificial sequence
  siRNA Antisense Sequence
caaaaccggaauaucaacu

SEQ ID NO: 4701 - RNA, 19 nt, artificial sequence
  siRNA Sense Sequence
guugauauuccgguuuugg

SEQ ID NO: 4702 - RNA, 19 nt, artificial sequence
  siRNA Antisense Sequence
ccaaaaccggaauaucaac

SEQ ID NO: 4703 - RNA, 19 nt, artificial sequence
  siRNA Sense Sequence
uugauauuccgguuuuggu

SEQ ID NO: 4704 - RNA, 19 nt, artificial sequence
  siRNA Antisense Sequence
accaaaaccggaauaucaa

SEQ ID NO: 4705 - RNA, 19 nt, artificial sequence
  siRNA Sense Sequence
ugauauuccgguuuuggua

SEQ ID NO: 4706 - RNA, 19 nt, artificial sequence
  siRNA Antisense Sequence
uaccaaaaccggaauauca

SEQ ID NO: 4707 - RNA, 19 nt, artificial sequence
  siRNA Sense Sequence
gauauuccgguuuugguau

SEQ ID NO: 4708 - RNA, 19 nt, artificial sequence
  siRNA Antisense Sequence
auaccaaaaccggaauauc

SEQ ID NO: 4709 - RNA, 19 nt, artificial sequence
  siRNA Sense Sequence
auauuccgguuuugguauu

SEQ ID NO: 4710 - RNA, 19 nt, artificial sequence
  siRNA Antisense Sequence
aauaccaaaaccggaauau

SEQ ID NO: 4711 - RNA, 19 nt, artificial sequence
  siRNA Sense Sequence
uauuccgguuuugguauuc

SEQ ID NO: 4712 - RNA, 19 nt, artificial sequence
  siRNA Antisense Sequence
gaauaccaaaaccggaaua

SEQ ID NO: 4713 - RNA, 19 nt, artificial sequence
  siRNA Sense Sequence
auuccgguuuugguauucu

SEQ ID NO: 4714 - RNA, 19 nt, artificial sequence
  siRNA Antisense Sequence
agaauaccaaaaccggaau

SEQ ID NO: 4715 - RNA, 19 nt, artificial sequence
  siRNA Sense Sequence
uuccgguuuugguauucuu

SEQ ID NO: 4716 - RNA, 19 nt, artificial sequence
  siRNA Antisense Sequence
aagaauaccaaaaccggaa

SEQ ID NO: 4717 - RNA, 19 nt, artificial sequence
  siRNA Sense Sequence
gguuuugguauucuuucug

SEQ ID NO: 4718 - RNA, 19 nt, artificial sequence
  siRNA Antisense Sequence
cagaaagaauaccaaaacc

SEQ ID NO: 4719 - RNA, 19 nt, artificial sequence
  siRNA Sense Sequence
uuuugguauucuuucugac

SEQ ID NO: 4720 - RNA, 19 nt, artificial sequence
  siRNA Antisense Sequence
gucagaaagaauaccaaaa

SEQ ID NO: 4721 - RNA, 19 nt, artificial sequence
  siRNA Sense Sequence
gguauucuuucugacccug

SEQ ID NO: 4722 - RNA, 19 nt, artificial sequence
  siRNA Antisense Sequence
cagggucagaaagaauacc

SEQ ID NO: 4723 - RNA, 19 nt, artificial sequence
  siRNA Sense Sequence
aacuccuuaccugaugucu

SEQ ID NO: 4724 - RNA, 19 nt, artificial sequence
  siRNA Antisense Sequence
agacaucagguaaggaguu

SEQ ID NO: 4725 - RNA, 19 nt, artificial sequence
  siRNA Sense Sequence
acuccuuaccugaugucug

SEQ ID NO: 4726 - RNA, 19 nt, artificial sequence
  siRNA Antisense Sequence
cagacaucagguaaggagu

SEQ ID NO: 4727 - RNA, 19 nt, artificial sequence
  siRNA Sense Sequence
cuccuuaccugaugucugg

SEQ ID NO: 4728 - RNA, 19 nt, artificial sequence
  siRNA Antisense Sequence
ccagacaucagguaaggag

SEQ ID NO: 4729 - RNA, 19 nt, artificial sequence
  siRNA Sense Sequence
uccuuaccugaugucuggu

SEQ ID NO: 4730 - RNA, 19 nt, artificial sequence
  siRNA Antisense Sequence
accagacaucagguaagga

SEQ ID NO: 4731 - RNA, 19 nt, artificial sequence
  siRNA Sense Sequence
ccuuaccugaugucugguc

SEQ ID NO: 4732 - RNA, 19 nt, artificial sequence
  siRNA Antisense Sequence
gaccagacaucagguaagg

SEQ ID NO: 4733 - RNA, 19 nt, artificial sequence
  siRNA Sense Sequence
cuuaccugaugucuggucu

SEQ ID NO: 4734 - RNA, 19 nt, artificial sequence
  siRNA Antisense Sequence
agaccagacaucagguaag

SEQ ID NO: 4735 - RNA, 19 nt, artificial sequence
  siRNA Sense Sequence
uuaccugaugucuggucua

SEQ ID NO: 4736 - RNA, 19 nt, artificial sequence
  siRNA Antisense Sequence
uagaccagacaucagguaa

SEQ ID NO: 4737 - RNA, 19 nt, artificial sequence
  siRNA Sense Sequence
uaccugaugucuggucuau

SEQ ID NO: 4738 - RNA, 19 nt, artificial sequence
  siRNA Antisense Sequence
auagaccagacaucaggua

SEQ ID NO: 4739 - RNA, 19 nt, artificial sequence
  siRNA Sense Sequence
accugaugucuggucuauc

SEQ ID NO: 4740 - RNA, 19 nt, artificial sequence
  siRNA Antisense Sequence
gauagaccagacaucaggu

SEQ ID NO: 4741 - RNA, 19 nt, artificial sequence
  siRNA Sense Sequence
gaugucuggucuaucacag

SEQ ID NO: 4742 - RNA, 19 nt, artificial sequence
  siRNA Antisense Sequence
cugugauagaccagacauc

SEQ ID NO: 4743 - RNA, 19 nt, artificial sequence
  siRNA Sense Sequence
augucuggucuaucacagu

SEQ ID NO: 4744 - RNA, 19 nt, artificial sequence
  siRNA Antisense Sequence
acugugauagaccagacau

SEQ ID NO: 4745 - RNA, 19 nt, artificial sequence
  siRNA Sense Sequence
ugucuggucuaucacaguc

SEQ ID NO: 4746 - RNA, 19 nt, artificial sequence
  siRNA Antisense Sequence
gacugugauagaccagaca

SEQ ID NO: 4747 - RNA, 19 nt, artificial sequence
  siRNA Sense Sequence
gucuggucuaucacaguca

SEQ ID NO: 4748 - RNA, 19 nt, artificial sequence
  siRNA Antisense Sequence
ugacugugauagaccagac

SEQ ID NO: 4749 - RNA, 19 nt, artificial sequence
  siRNA Sense Sequence
ucuggucuaucacagucaa

SEQ ID NO: 4750 - RNA, 19 nt, artificial sequence
  siRNA Antisense Sequence
uugacugugauagaccaga

SEQ ID NO: 4751 - RNA, 19 nt, artificial sequence
  siRNA Sense Sequence
cuggucuaucacagucaac

SEQ ID NO: 4752 - RNA, 19 nt, artificial sequence
  siRNA Antisense Sequence
guugacugugauagaccag

SEQ ID NO: 4753 - RNA, 19 nt, artificial sequence
  siRNA Sense Sequence
uggucuaucacagucaacu

SEQ ID NO: 4754 - RNA, 19 nt, artificial sequence
  siRNA Antisense Sequence
aguugacugugauagacca

SEQ ID NO: 4755 - RNA, 19 nt, artificial sequence
  siRNA Sense Sequence
cuaucacagucaacuuacu

SEQ ID NO: 4756 - RNA, 19 nt, artificial sequence
  siRNA Antisense Sequence
aguaaguugacugugauag

SEQ ID NO: 4757 - RNA, 19 nt, artificial sequence
  siRNA Sense Sequence
uaucacagucaacuuacua

SEQ ID NO: 4758 - RNA, 19 nt, artificial sequence
  siRNA Antisense Sequence
uaguaaguugacugugaua

SEQ ID NO: 4759 - RNA, 19 nt, artificial sequence
  siRNA Sense Sequence
acagucaacuuacuagcac

SEQ ID NO: 4760 - RNA, 19 nt, artificial sequence
  siRNA Antisense Sequence
gugcuaguaaguugacugu

SEQ ID NO: 4761 - RNA, 19 nt, artificial sequence
  siRNA Sense Sequence
aacuuacuagcacuggguc

SEQ ID NO: 4762 - RNA, 19 nt, artificial sequence
  siRNA Antisense Sequence
gacccagugcuaguaaguu

SEQ ID NO: 4763 - RNA, 19 nt, artificial sequence
  siRNA Sense Sequence
acuuacuagcacugggucu

SEQ ID NO: 4764 - RNA, 19 nt, artificial sequence
  siRNA Antisense Sequence
agacccagugcuaguaagu

SEQ ID NO: 4765 - RNA, 19 nt, artificial sequence
  siRNA Sense Sequence
cuuacuagcacugggucug

SEQ ID NO: 4766 - RNA, 19 nt, artificial sequence
  siRNA Antisense Sequence
cagacccagugcuaguaag

SEQ ID NO: 4767 - RNA, 19 nt, artificial sequence
  siRNA Sense Sequence
uuacuagcacugggucugu

SEQ ID NO: 4768 - RNA, 19 nt, artificial sequence
  siRNA Antisense Sequence
acagacccagugcuaguaa

SEQ ID NO: 4769 - RNA, 19 nt, artificial sequence
  siRNA Sense Sequence
uacuagcacugggucuguu

SEQ ID NO: 4770 - RNA, 19 nt, artificial sequence
  siRNA Antisense Sequence
aacagacccagugcuagua

SEQ ID NO: 4771 - RNA, 19 nt, artificial sequence
  siRNA Sense Sequence
acuagcacugggucuguuu

SEQ ID NO: 4772 - RNA, 19 nt, artificial sequence
  siRNA Antisense Sequence
aaacagacccagugcuagu

SEQ ID NO: 4773 - RNA, 19 nt, artificial sequence
  siRNA Sense Sequence
cugggucuguuucucaugc

SEQ ID NO: 4774 - RNA, 19 nt, artificial sequence
  siRNA Antisense Sequence
gcaugagaaacagacccag

SEQ ID NO: 4775 - RNA, 19 nt, artificial sequence
  siRNA Sense Sequence
ugggucuguuucucaugcc

SEQ ID NO: 4776 - RNA, 19 nt, artificial sequence
  siRNA Antisense Sequence
ggcaugagaaacagaccca

SEQ ID NO: 4777 - RNA, 19 nt, artificial sequence
  siRNA Sense Sequence
gggucuguuucucaugcca

SEQ ID NO: 4778 - RNA, 19 nt, artificial sequence
  siRNA Antisense Sequence
uggcaugagaaacagaccc

SEQ ID NO: 4779 - RNA, 19 nt, artificial sequence
  siRNA Sense Sequence
ggucuguuucucaugccag

SEQ ID NO: 4780 - RNA, 19 nt, artificial sequence
  siRNA Antisense Sequence
cuggcaugagaaacagacc

SEQ ID NO: 4781 - RNA, 19 nt, artificial sequence
  siRNA Sense Sequence
uguuucucaugccaggugg

SEQ ID NO: 4782 - RNA, 19 nt, artificial sequence
  siRNA Antisense Sequence
ccaccuggcaugagaaaca

SEQ ID NO: 4783 - RNA, 19 nt, artificial sequence
  siRNA Sense Sequence
guuucucaugccagguggc

SEQ ID NO: 4784 - RNA, 19 nt, artificial sequence
  siRNA Antisense Sequence
gccaccuggcaugagaaac

SEQ ID NO: 4785 - RNA, 19 nt, artificial sequence
  siRNA Sense Sequence
uuucucaugccagguggcu

SEQ ID NO: 4786 - RNA, 19 nt, artificial sequence
  siRNA Antisense Sequence
agccaccuggcaugagaaa

SEQ ID NO: 4787 - RNA, 19 nt, artificial sequence
  siRNA Sense Sequence
uucucaugccagguggcua

SEQ ID NO: 4788 - RNA, 19 nt, artificial sequence
  siRNA Antisense Sequence
uagccaccuggcaugagaa

SEQ ID NO: 4789 - RNA, 19 nt, artificial sequence
  siRNA Sense Sequence
ucucaugccagguggcuac

SEQ ID NO: 4790 - RNA, 19 nt, artificial sequence
  siRNA Antisense Sequence
guagccaccuggcaugaga

SEQ ID NO: 4791 - RNA, 19 nt, artificial sequence
  siRNA Sense Sequence
cucaugccagguggcuacu

SEQ ID NO: 4792 - RNA, 19 nt, artificial sequence
  siRNA Antisense Sequence
aguagccaccuggcaugag

SEQ ID NO: 4793 - RNA, 19 nt, artificial sequence
  siRNA Sense Sequence
caacugcugcacagacucc

SEQ ID NO: 4794 - RNA, 19 nt, artificial sequence
  siRNA Antisense Sequence
ggagucugugcagcaguug

SEQ ID NO: 4795 - RNA, 19 nt, artificial sequence
  siRNA Sense Sequence
cacagacuccaaccucaau

SEQ ID NO: 4796 - RNA, 19 nt, artificial sequence
  siRNA Antisense Sequence
auugagguuggagucugug

SEQ ID NO: 4797 - RNA, 19 nt, artificial sequence
  siRNA Sense Sequence
acagacuccaaccucaaug

SEQ ID NO: 4798 - RNA, 19 nt, artificial sequence
  siRNA Antisense Sequence
cauugagguuggagucugu

SEQ ID NO: 4799 - RNA, 19 nt, artificial sequence
  siRNA Sense Sequence
cagacuccaaccucaaugg

SEQ ID NO: 4800 - RNA, 19 nt, artificial sequence
  siRNA Antisense Sequence
ccauugagguuggagucug

SEQ ID NO: 4801 - RNA, 19 nt, artificial sequence
  siRNA Sense Sequence
ccaaccucaauggagugua

SEQ ID NO: 4802 - RNA, 19 nt, artificial sequence
  siRNA Antisense Sequence
uacacuccauugagguugg

SEQ ID NO: 4803 - RNA, 19 nt, artificial sequence
  siRNA Sense Sequence
caaccucaauggaguguac

SEQ ID NO: 4804 - RNA, 19 nt, artificial sequence
  siRNA Antisense Sequence
guacacuccauugagguug

SEQ ID NO: 4805 - RNA, 19 nt, artificial sequence
  siRNA Sense Sequence
aaccucaauggaguguacu

SEQ ID NO: 4806 - RNA, 19 nt, artificial sequence
  siRNA Antisense Sequence
aguacacuccauugagguu

SEQ ID NO: 4807 - RNA, 19 nt, artificial sequence
  siRNA Sense Sequence
accucaauggaguguacua

SEQ ID NO: 4808 - RNA, 19 nt, artificial sequence
  siRNA Antisense Sequence
uaguacacuccauugaggu

SEQ ID NO: 4809 - RNA, 19 nt, artificial sequence
  siRNA Sense Sequence
ccucaauggaguguacuac

SEQ ID NO: 4810 - RNA, 19 nt, artificial sequence
  siRNA Antisense Sequence
guaguacacuccauugagg

SEQ ID NO: 4811 - RNA, 19 nt, artificial sequence
  siRNA Sense Sequence
cucaauggaguguacuacc

SEQ ID NO: 4812 - RNA, 19 nt, artificial sequence
  siRNA Antisense Sequence
gguaguacacuccauugag

SEQ ID NO: 4813 - RNA, 19 nt, artificial sequence
  siRNA Sense Sequence
ucaauggaguguacuaccg

SEQ ID NO: 4814 - RNA, 19 nt, artificial sequence
  siRNA Antisense Sequence
cgguaguacacuccauuga

SEQ ID NO: 4815 - RNA, 19 nt, artificial sequence
  siRNA Sense Sequence
caauggaguguacuaccgc

SEQ ID NO: 4816 - RNA, 19 nt, artificial sequence
  siRNA Antisense Sequence
gcgguaguacacuccauug

SEQ ID NO: 4817 - RNA, 19 nt, artificial sequence
  siRNA Sense Sequence
aauggaguguacuaccgcc

SEQ ID NO: 4818 - RNA, 19 nt, artificial sequence
  siRNA Antisense Sequence
ggcgguaguacacuccauu

SEQ ID NO: 4819 - RNA, 19 nt, artificial sequence
  siRNA Sense Sequence
auggaguguacuaccgccu

SEQ ID NO: 4820 - RNA, 19 nt, artificial sequence
  siRNA Antisense Sequence
aggcgguaguacacuccau

SEQ ID NO: 4821 - RNA, 19 nt, artificial sequence
  siRNA Sense Sequence
uggaguguacuaccgccug

SEQ ID NO: 4822 - RNA, 19 nt, artificial sequence
  siRNA Antisense Sequence
caggcgguaguacacucca

SEQ ID NO: 4823 - RNA, 19 nt, artificial sequence
  siRNA Sense Sequence
ggaguguacuaccgccugg

SEQ ID NO: 4824 - RNA, 19 nt, artificial sequence
  siRNA Antisense Sequence
ccaggcgguaguacacucc

SEQ ID NO: 4825 - RNA, 19 nt, artificial sequence
  siRNA Sense Sequence
gaguguacuaccgccuggg

SEQ ID NO: 4826 - RNA, 19 nt, artificial sequence
  siRNA Antisense Sequence
cccaggcgguaguacacuc

SEQ ID NO: 4827 - RNA, 19 nt, artificial sequence
  siRNA Sense Sequence
aguguacuaccgccugggu

SEQ ID NO: 4828 - RNA, 19 nt, artificial sequence
  siRNA Antisense Sequence
acccaggcgguaguacacu

SEQ ID NO: 4829 - RNA, 19 nt, artificial sequence
  siRNA Sense Sequence
guacuaccgccugggugag

SEQ ID NO: 4830 - RNA, 19 nt, artificial sequence
  siRNA Antisense Sequence
cucacccaggcgguaguac

SEQ ID NO: 4831 - RNA, 19 nt, artificial sequence
  siRNA Sense Sequence
uacuaccgccugggugagc

SEQ ID NO: 4832 - RNA, 19 nt, artificial sequence
  siRNA Antisense Sequence
gcucacccaggcgguagua

SEQ ID NO: 4833 - RNA, 19 nt, artificial sequence
  siRNA Sense Sequence
acuaccgccugggugagca

SEQ ID NO: 4834 - RNA, 19 nt, artificial sequence
  siRNA Antisense Sequence
ugcucacccaggcgguagu

SEQ ID NO: 4835 - RNA, 19 nt, artificial sequence
  siRNA Sense Sequence
caauaagcaccuggauggc

SEQ ID NO: 4836 - RNA, 19 nt, artificial sequence
  siRNA Antisense Sequence
gccauccaggugcuuauug

SEQ ID NO: 4837 - RNA, 19 nt, artificial sequence
  siRNA Sense Sequence
aauaagcaccuggauggca

SEQ ID NO: 4838 - RNA, 19 nt, artificial sequence
  siRNA Antisense Sequence
ugccauccaggugcuuauu

SEQ ID NO: 4839 - RNA, 19 nt, artificial sequence
  siRNA Sense Sequence
auaagcaccuggauggcau

SEQ ID NO: 4840 - RNA, 19 nt, artificial sequence
  siRNA Antisense Sequence
augccauccaggugcuuau

SEQ ID NO: 4841 - RNA, 19 nt, artificial sequence
  siRNA Sense Sequence
uaagcaccuggauggcauc

SEQ ID NO: 4842 - RNA, 19 nt, artificial sequence
  siRNA Antisense Sequence
gaugccauccaggugcuua

SEQ ID NO: 4843 - RNA, 19 nt, artificial sequence
  siRNA Sense Sequence
aagcaccuggauggcauca

SEQ ID NO: 4844 - RNA, 19 nt, artificial sequence
  siRNA Antisense Sequence
ugaugccauccaggugcuu

SEQ ID NO: 4845 - RNA, 19 nt, artificial sequence
  siRNA Sense Sequence
agcaccuggauggcaucac

SEQ ID NO: 4846 - RNA, 19 nt, artificial sequence
  siRNA Antisense Sequence
gugaugccauccaggugcu

SEQ ID NO: 4847 - RNA, 19 nt, artificial sequence
  siRNA Sense Sequence
gcaccuggauggcaucacc

SEQ ID NO: 4848 - RNA, 19 nt, artificial sequence
  siRNA Antisense Sequence
ggugaugccauccaggugc

SEQ ID NO: 4849 - RNA, 19 nt, artificial sequence
  siRNA Sense Sequence
caccuggauggcaucaccu

SEQ ID NO: 4850 - RNA, 19 nt, artificial sequence
  siRNA Antisense Sequence
aggugaugccauccaggug

SEQ ID NO: 4851 - RNA, 19 nt, artificial sequence
  siRNA Sense Sequence
uggauggcaucaccuggua

SEQ ID NO: 4852 - RNA, 19 nt, artificial sequence
  siRNA Antisense Sequence
uaccaggugaugccaucca

SEQ ID NO: 4853 - RNA, 19 nt, artificial sequence
  siRNA Sense Sequence
uggcauggaucuaccuacu

SEQ ID NO: 4854 - RNA, 19 nt, artificial sequence
  siRNA Antisense Sequence
aguagguagauccaugcca

SEQ ID NO: 4855 - RNA, 19 nt, artificial sequence
  siRNA Sense Sequence
ggcauggaucuaccuacuc

SEQ ID NO: 4856 - RNA, 19 nt, artificial sequence
  siRNA Antisense Sequence
gaguagguagauccaugcc

SEQ ID NO: 4857 - RNA, 19 nt, artificial sequence
  siRNA Sense Sequence
gcauggaucuaccuacucc

SEQ ID NO: 4858 - RNA, 19 nt, artificial sequence
  siRNA Antisense Sequence
ggaguagguagauccaugc

SEQ ID NO: 4859 - RNA, 19 nt, artificial sequence
  siRNA Sense Sequence
cauggaucuaccuacuccc

SEQ ID NO: 4860 - RNA, 19 nt, artificial sequence
  siRNA Antisense Sequence
gggaguagguagauccaug

SEQ ID NO: 4861 - RNA, 19 nt, artificial sequence
  siRNA Sense Sequence
auggaucuaccuacucccu

SEQ ID NO: 4862 - RNA, 19 nt, artificial sequence
  siRNA Antisense Sequence
agggaguagguagauccau

SEQ ID NO: 4863 - RNA, 19 nt, artificial sequence
  siRNA Sense Sequence
uggaucuaccuacucccuc

SEQ ID NO: 4864 - RNA, 19 nt, artificial sequence
  siRNA Antisense Sequence
gagggaguagguagaucca

SEQ ID NO: 4865 - RNA, 19 nt, artificial sequence
  siRNA Sense Sequence
ggaucuaccuacucccuca

SEQ ID NO: 4866 - RNA, 19 nt, artificial sequence
  siRNA Antisense Sequence
ugagggaguagguagaucc

SEQ ID NO: 4867 - RNA, 19 nt, artificial sequence
  siRNA Sense Sequence
gaucuaccuacucccucaa

SEQ ID NO: 4868 - RNA, 19 nt, artificial sequence
  siRNA Antisense Sequence
uugagggaguagguagauc

SEQ ID NO: 4869 - RNA, 19 nt, artificial sequence
  siRNA Sense Sequence
aucuaccuacucccucaaa

SEQ ID NO: 4870 - RNA, 19 nt, artificial sequence
  siRNA Antisense Sequence
uuugagggaguagguagau

SEQ ID NO: 4871 - RNA, 19 nt, artificial sequence
  siRNA Sense Sequence
cgcccagaagacuucaagc

SEQ ID NO: 4872 - RNA, 19 nt, artificial sequence
  siRNA Antisense Sequence
gcuugaagucuucugggcg

SEQ ID NO: 4873 - RNA, 19 nt, artificial sequence
  siRNA Sense Sequence
gcccagaagacuucaagcc

SEQ ID NO: 4874 - RNA, 19 nt, artificial sequence
  siRNA Antisense Sequence
ggcuugaagucuucugggc

SEQ ID NO: 4875 - RNA, 19 nt, artificial sequence
  siRNA Sense Sequence
cccagaagacuucaagccu

SEQ ID NO: 4876 - RNA, 19 nt, artificial sequence
  siRNA Antisense Sequence
aggcuugaagucuucuggg

SEQ ID NO: 4877 - RNA, 19 nt, artificial sequence
  siRNA Sense Sequence
ccagaagacuucaagccuu

SEQ ID NO: 4878 - RNA, 19 nt, artificial sequence
  siRNA Antisense Sequence
aaggcuugaagucuucugg

SEQ ID NO: 4879 - RNA, 19 nt, artificial sequence
  siRNA Sense Sequence
cagaagacuucaagccuua

SEQ ID NO: 4880 - RNA, 19 nt, artificial sequence
  siRNA Antisense Sequence
uaaggcuugaagucuucug

SEQ ID NO: 4881 - RNA, 19 nt, artificial sequence
  siRNA Sense Sequence
gaagacuucaagccuuaaa

SEQ ID NO: 4882 - RNA, 19 nt, artificial sequence
  siRNA Antisense Sequence
uuuaaggcuugaagucuuc

SEQ ID NO: 4883 - RNA, 19 nt, artificial sequence
  siRNA Sense Sequence
aagacuucaagccuuaaaa

SEQ ID NO: 4884 - RNA, 19 nt, artificial sequence
  siRNA Antisense Sequence
uuuuaaggcuugaagucuu

SEQ ID NO: 4885 - RNA, 19 nt, artificial sequence
  siRNA Sense Sequence
agacuucaagccuuaaaag

SEQ ID NO: 4886 - RNA, 19 nt, artificial sequence
  siRNA Antisense Sequence
cuuuuaaggcuugaagucu

SEQ ID NO: 4887 - RNA, 19 nt, artificial sequence
  siRNA Sense Sequence
gacuucaagccuuaaaagg

SEQ ID NO: 4888 - RNA, 19 nt, artificial sequence
  siRNA Antisense Sequence
ccuuuuaaggcuugaaguc

SEQ ID NO: 4889 - RNA, 19 nt, artificial sequence
  siRNA Sense Sequence
acuucaagccuuaaaagga

SEQ ID NO: 4890 - RNA, 19 nt, artificial sequence
  siRNA Antisense Sequence
uccuuuuaaggcuugaagu

SEQ ID NO: 4891 - RNA, 19 nt, artificial sequence
  siRNA Sense Sequence
cuucaagccuuaaaaggag

SEQ ID NO: 4892 - RNA, 19 nt, artificial sequence
  siRNA Antisense Sequence
cuccuuuuaaggcuugaag

SEQ ID NO: 4893 - RNA, 19 nt, artificial sequence
  siRNA Sense Sequence
uucaagccuuaaaaggagg

SEQ ID NO: 4894 - RNA, 19 nt, artificial sequence
  siRNA Antisense Sequence
ccuccuuuuaaggcuugaa

SEQ ID NO: 4895 - RNA, 19 nt, artificial sequence
  siRNA Sense Sequence
ccuuaaaaggaggcugccg

SEQ ID NO: 4896 - RNA, 19 nt, artificial sequence
  siRNA Antisense Sequence
cggcagccuccuuuuaagg

SEQ ID NO: 4897 - RNA, 19 nt, artificial sequence
  siRNA Sense Sequence
cuuaaaaggaggcugccgu

SEQ ID NO: 4898 - RNA, 19 nt, artificial sequence
  siRNA Antisense Sequence
acggcagccuccuuuuaag

SEQ ID NO: 4899 - RNA, 19 nt, artificial sequence
  siRNA Sense Sequence
uuaaaaggaggcugccgug

SEQ ID NO: 4900 - RNA, 19 nt, artificial sequence
  siRNA Antisense Sequence
cacggcagccuccuuuuaa

SEQ ID NO: 4901 - RNA, 19 nt, artificial sequence
  siRNA Sense Sequence
uaaaaggaggcugccgugg

SEQ ID NO: 4902 - RNA, 19 nt, artificial sequence
  siRNA Antisense Sequence
ccacggcagccuccuuuua

SEQ ID NO: 4903 - RNA, 19 nt, artificial sequence
  siRNA Sense Sequence
aaaaggaggcugccgugga

SEQ ID NO: 4904 - RNA, 19 nt, artificial sequence
  siRNA Antisense Sequence
uccacggcagccuccuuuu

SEQ ID NO: 4905 - RNA, 19 nt, artificial sequence
  siRNA Sense Sequence
aaaggaggcugccguggag

SEQ ID NO: 4906 - RNA, 19 nt, artificial sequence
  siRNA Antisense Sequence
cuccacggcagccuccuuu

SEQ ID NO: 4907 - RNA, 19 nt, artificial sequence
  siRNA Sense Sequence
guggagcacggauacagaa

SEQ ID NO: 4908 - RNA, 19 nt, artificial sequence
  siRNA Antisense Sequence
uucuguauccgugcuccac

SEQ ID NO: 4909 - RNA, 19 nt, artificial sequence
  siRNA Sense Sequence
acuggaugagggcagauga

SEQ ID NO: 4910 - RNA, 19 nt, artificial sequence
  siRNA Antisense Sequence
ucaucugcccucauccagu

SEQ ID NO: 4911 - RNA, 19 nt, artificial sequence
  siRNA Sense Sequence
cuggaugagggcagaugag

SEQ ID NO: 4912 - RNA, 19 nt, artificial sequence
  siRNA Antisense Sequence
cucaucugcccucauccag

SEQ ID NO: 4913 - RNA, 19 nt, artificial sequence
  siRNA Sense Sequence
ggaugagggcagaugagga

SEQ ID NO: 4914 - RNA, 19 nt, artificial sequence
  siRNA Antisense Sequence
uccucaucugcccucaucc

SEQ ID NO: 4915 - RNA, 19 nt, artificial sequence
  siRNA Sense Sequence
augagggcagaugaggaca

SEQ ID NO: 4916 - RNA, 19 nt, artificial sequence
  siRNA Antisense Sequence
uguccucaucugcccucau

SEQ ID NO: 4917 - RNA, 19 nt, artificial sequence
  siRNA Sense Sequence
ugagggcagaugaggacag

SEQ ID NO: 4918 - RNA, 19 nt, artificial sequence
  siRNA Antisense Sequence
cuguccucaucugcccuca

SEQ ID NO: 4919 - RNA, 19 nt, artificial sequence
  siRNA Sense Sequence
agggcagaugaggacagga

SEQ ID NO: 4920 - RNA, 19 nt, artificial sequence
  siRNA Antisense Sequence
uccuguccucaucugcccu

SEQ ID NO: 4921 - RNA, 19 nt, artificial sequence
  siRNA Sense Sequence
ggcagaugaggacaggaag

SEQ ID NO: 4922 - RNA, 19 nt, artificial sequence
  siRNA Antisense Sequence
cuuccuguccucaucugcc

SEQ ID NO: 4923 - RNA, 19 nt, artificial sequence
  siRNA Sense Sequence
cagaugaggacaggaagag

SEQ ID NO: 4924 - RNA, 19 nt, artificial sequence
  siRNA Antisense Sequence
cucuuccuguccucaucug

SEQ ID NO: 4925 - RNA, 19 nt, artificial sequence
  siRNA Sense Sequence
gaauaagucuccaaggagc

SEQ ID NO: 4926 - RNA, 19 nt, artificial sequence
  siRNA Antisense Sequence
gcuccuuggagacuuauuc

SEQ ID NO: 4927 - RNA, 19 nt, artificial sequence
  siRNA Sense Sequence
aauaagucuccaaggagca

SEQ ID NO: 4928 - RNA, 19 nt, artificial sequence
  siRNA Antisense Sequence
ugcuccuuggagacuuauu

SEQ ID NO: 4929 - RNA, 19 nt, artificial sequence
  siRNA Sense Sequence
auaagucuccaaggagcac

SEQ ID NO: 4930 - RNA, 19 nt, artificial sequence
  siRNA Antisense Sequence
gugcuccuuggagacuuau

SEQ ID NO: 4931 - RNA, 19 nt, artificial sequence
  siRNA Sense Sequence
aaaggcuagcaaagagcaa

SEQ ID NO: 4932 - RNA, 19 nt, artificial sequence
  siRNA Antisense Sequence
uugcucuuugcuagccuuu

SEQ ID NO: 4933 - RNA, 19 nt, artificial sequence
  siRNA Sense Sequence
aaggcuagcaaagagcaag

SEQ ID NO: 4934 - RNA, 19 nt, artificial sequence
  siRNA Antisense Sequence
cuugcucuuugcuagccuu

SEQ ID NO: 4935 - RNA, 19 nt, artificial sequence
  siRNA Sense Sequence
aggcuagcaaagagcaagg

SEQ ID NO: 4936 - RNA, 19 nt, artificial sequence
  siRNA Antisense Sequence
ccuugcucuuugcuagccu

SEQ ID NO: 4937 - RNA, 19 nt, artificial sequence
  siRNA Sense Sequence
ggcuagcaaagagcaagga

SEQ ID NO: 4938 - RNA, 19 nt, artificial sequence
  siRNA Antisense Sequence
uccuugcucuuugcuagcc

SEQ ID NO: 4939 - RNA, 19 nt, artificial sequence
  siRNA Sense Sequence
gcuagcaaagagcaaggaa

SEQ ID NO: 4940 - RNA, 19 nt, artificial sequence
  siRNA Antisense Sequence
uuccuugcucuuugcuagc

SEQ ID NO: 4941 - RNA, 19 nt, artificial sequence
  siRNA Sense Sequence
caaaguggcgaggcccuca

SEQ ID NO: 4942 - RNA, 19 nt, artificial sequence
  siRNA Antisense Sequence
ugagggccucgccacuuug

SEQ ID NO: 4943 - RNA, 19 nt, artificial sequence
  siRNA Sense Sequence
aaaguggcgaggcccucag

SEQ ID NO: 4944 - RNA, 19 nt, artificial sequence
  siRNA Antisense Sequence
cugagggccucgccacuuu

SEQ ID NO: 4945 - RNA, 19 nt, artificial sequence
  siRNA Sense Sequence
aaguggcgaggcccucaga

SEQ ID NO: 4946 - RNA, 19 nt, artificial sequence
  siRNA Antisense Sequence
ucugagggccucgccacuu

SEQ ID NO: 4947 - RNA, 19 nt, artificial sequence
  siRNA Sense Sequence
gcgaggcccucagagugaa

SEQ ID NO: 4948 - RNA, 19 nt, artificial sequence
  siRNA Antisense Sequence
uucacucugagggccucgc

SEQ ID NO: 4949 - RNA, 19 nt, artificial sequence
  siRNA Sense Sequence
aaagcguaagguucaguca

SEQ ID NO: 4950 - RNA, 19 nt, artificial sequence
  siRNA Antisense Sequence
ugacugaaccuuacgcuuu

SEQ ID NO: 4951 - RNA, 19 nt, artificial sequence
  siRNA Sense Sequence
aagagccuuccucacccaa

SEQ ID NO: 4952 - RNA, 19 nt, artificial sequence
  siRNA Antisense Sequence
uugggugaggaaggcucuu

SEQ ID NO: 4953 - RNA, 19 nt, artificial sequence
  siRNA Sense Sequence
agagccuuccucacccaaa

SEQ ID NO: 4954 - RNA, 19 nt, artificial sequence
  siRNA Antisense Sequence
uuugggugaggaaggcucu

SEQ ID NO: 4955 - RNA, 19 nt, artificial sequence
  siRNA Sense Sequence
aaaagccucucucagcugu

SEQ ID NO: 4956 - RNA, 19 nt, artificial sequence
  siRNA Antisense Sequence
acagcugagagaggcuuuu

SEQ ID NO: 4957 - RNA, 19 nt, artificial sequence
  siRNA Sense Sequence
aaagccucucucagcugug

SEQ ID NO: 4958 - RNA, 19 nt, artificial sequence
  siRNA Antisense Sequence
cacagcugagagaggcuuu

SEQ ID NO: 4959 - RNA, 19 nt, artificial sequence
  siRNA Sense Sequence
ucagcugugaccuggcucu

SEQ ID NO: 4960 - RNA, 19 nt, artificial sequence
  siRNA Antisense Sequence
agagccaggucacagcuga

SEQ ID NO: 4961 - RNA, 19 nt, artificial sequence
  siRNA Sense Sequence
ugaccuggcucugcauuuu

SEQ ID NO: 4962 - RNA, 19 nt, artificial sequence
  siRNA Antisense Sequence
aaaaugcagagccagguca

SEQ ID NO: 4963 - RNA, 19 nt, artificial sequence
  siRNA Sense Sequence
accuggcucugcauuuuca

SEQ ID NO: 4964 - RNA, 19 nt, artificial sequence
  siRNA Antisense Sequence
ugaaaaugcagagccaggu

SEQ ID NO: 4965 - RNA, 19 nt, artificial sequence
  siRNA Sense Sequence
ccuggcucugcauuuucau

SEQ ID NO: 4966 - RNA, 19 nt, artificial sequence
  siRNA Antisense Sequence
augaaaaugcagagccagg

SEQ ID NO: 4967 - RNA, 19 nt, artificial sequence
  siRNA Sense Sequence
gcucugcauuuucaucgug

SEQ ID NO: 4968 - RNA, 19 nt, artificial sequence
  siRNA Antisense Sequence
cacgaugaaaaugcagagc

SEQ ID NO: 4969 - RNA, 19 nt, artificial sequence
  siRNA Sense Sequence
cucugcauuuucaucgugg

SEQ ID NO: 4970 - RNA, 19 nt, artificial sequence
  siRNA Antisense Sequence
ccacgaugaaaaugcagag

SEQ ID NO: 4971 - RNA, 19 nt, artificial sequence
  siRNA Sense Sequence
ucugcauuuucaucguggc

SEQ ID NO: 4972 - RNA, 19 nt, artificial sequence
  siRNA Antisense Sequence
gccacgaugaaaaugcaga

SEQ ID NO: 4973 - RNA, 19 nt, artificial sequence
  siRNA Sense Sequence
cugcauuuucaucguggcc

SEQ ID NO: 4974 - RNA, 19 nt, artificial sequence
  siRNA Antisense Sequence
ggccacgaugaaaaugcag

SEQ ID NO: 4975 - RNA, 19 nt, artificial sequence
  siRNA Sense Sequence
ugcauuuucaucguggccu

SEQ ID NO: 4976 - RNA, 19 nt, artificial sequence
  siRNA Antisense Sequence
aggccacgaugaaaaugca

SEQ ID NO: 4977 - RNA, 19 nt, artificial sequence
  siRNA Sense Sequence
gcauuuucaucguggccuu

SEQ ID NO: 4978 - RNA, 19 nt, artificial sequence
  siRNA Antisense Sequence
aaggccacgaugaaaaugc

SEQ ID NO: 4979 - RNA, 19 nt, artificial sequence
  siRNA Sense Sequence
auuuucaucguggccuuug

SEQ ID NO: 4980 - RNA, 19 nt, artificial sequence
  siRNA Antisense Sequence
caaaggccacgaugaaaau

SEQ ID NO: 4981 - RNA, 19 nt, artificial sequence
  siRNA Sense Sequence
uuuucaucguggccuuugu

SEQ ID NO: 4982 - RNA, 19 nt, artificial sequence
  siRNA Antisense Sequence
acaaaggccacgaugaaaa

SEQ ID NO: 4983 - RNA, 19 nt, artificial sequence
  siRNA Sense Sequence
uuucaucguggccuuuguc

SEQ ID NO: 4984 - RNA, 19 nt, artificial sequence
  siRNA Antisense Sequence
gacaaaggccacgaugaaa

SEQ ID NO: 4985 - RNA, 19 nt, artificial sequence
  siRNA Sense Sequence
uucaucguggccuuuguca

SEQ ID NO: 4986 - RNA, 19 nt, artificial sequence
  siRNA Antisense Sequence
ugacaaaggccacgaugaa

SEQ ID NO: 4987 - RNA, 19 nt, artificial sequence
  siRNA Sense Sequence
ucaucguggccuuugucag

SEQ ID NO: 4988 - RNA, 19 nt, artificial sequence
  siRNA Antisense Sequence
cugacaaaggccacgauga

SEQ ID NO: 4989 - RNA, 19 nt, artificial sequence
  siRNA Sense Sequence
caucguggccuuugucagc

SEQ ID NO: 4990 - RNA, 19 nt, artificial sequence
  siRNA Antisense Sequence
gcugacaaaggccacgaug

SEQ ID NO: 4991 - RNA, 19 nt, artificial sequence
  siRNA Sense Sequence
aucguggccuuugucagcc

SEQ ID NO: 4992 - RNA, 19 nt, artificial sequence
  siRNA Antisense Sequence
ggcugacaaaggccacgau

SEQ ID NO: 4993 - RNA, 19 nt, artificial sequence
  siRNA Sense Sequence
ccuuugucagccacccagc

SEQ ID NO: 4994 - RNA, 19 nt, artificial sequence
  siRNA Antisense Sequence
gcuggguggcugacaaagg

SEQ ID NO: 4995 - RNA, 19 nt, artificial sequence
  siRNA Sense Sequence
cuuugucagccacccagcg

SEQ ID NO: 4996 - RNA, 19 nt, artificial sequence
  siRNA Antisense Sequence
cgcuggguggcugacaaag

SEQ ID NO: 4997 - RNA, 19 nt, artificial sequence
  siRNA Sense Sequence
uugucagccacccagcgug

SEQ ID NO: 4998 - RNA, 19 nt, artificial sequence
  siRNA Antisense Sequence
cacgcuggguggcugacaa

SEQ ID NO: 4999 - RNA, 19 nt, artificial sequence
  siRNA Sense Sequence
guggcugcagaagcucucu

SEQ ID NO: 5000 - RNA, 19 nt, artificial sequence
  siRNA Antisense Sequence
agagagcuucugcagccac

SEQ ID NO: 5001 - RNA, 19 nt, artificial sequence
  siRNA Sense Sequence
uggcugcagaagcucucua

SEQ ID NO: 5002 - RNA, 19 nt, artificial sequence
  siRNA Antisense Sequence
uagagagcuucugcagcca

SEQ ID NO: 5003 - RNA, 19 nt, artificial sequence
  siRNA Sense Sequence
ggcugcagaagcucucuaa

SEQ ID NO: 5004 - RNA, 19 nt, artificial sequence
  siRNA Antisense Sequence
uuagagagcuucugcagcc

SEQ ID NO: 5005 - RNA, 19 nt, artificial sequence
  siRNA Sense Sequence
gcugcagaagcucucuaag

SEQ ID NO: 5006 - RNA, 19 nt, artificial sequence
  siRNA Antisense Sequence
cuuagagagcuucugcagc

SEQ ID NO: 5007 - RNA, 19 nt, artificial sequence
  siRNA Sense Sequence
cugcagaagcucucuaagc

SEQ ID NO: 5008 - RNA, 19 nt, artificial sequence
  siRNA Antisense Sequence
gcuuagagagcuucugcag

SEQ ID NO: 5009 - RNA, 19 nt, artificial sequence
  siRNA Sense Sequence
ugcagaagcucucuaagca

SEQ ID NO: 5010 - RNA, 19 nt, artificial sequence
  siRNA Antisense Sequence
ugcuuagagagcuucugca

SEQ ID NO: 5011 - RNA, 19 nt, artificial sequence
  siRNA Sense Sequence
gcagaagcucucuaagcac

SEQ ID NO: 5012 - RNA, 19 nt, artificial sequence
  siRNA Antisense Sequence
gugcuuagagagcuucugc

SEQ ID NO: 5013 - RNA, 19 nt, artificial sequence
  siRNA Sense Sequence
ccagcacagccacagcuca

SEQ ID NO: 5014 - RNA, 19 nt, artificial sequence
  siRNA Antisense Sequence
ugagcuguggcugugcugg

SEQ ID NO: 5015 - RNA, 19 nt, artificial sequence
  siRNA Sense Sequence
cagcacagccacagcucaa

SEQ ID NO: 5016 - RNA, 19 nt, artificial sequence
  siRNA Antisense Sequence
uugagcuguggcugugcug

SEQ ID NO: 5017 - RNA, 19 nt, artificial sequence
  siRNA Sense Sequence
gcacagccacagcucaaag

SEQ ID NO: 5018 - RNA, 19 nt, artificial sequence
  siRNA Antisense Sequence
cuuugagcuguggcugugc

SEQ ID NO: 5019 - RNA, 19 nt, artificial sequence
  siRNA Sense Sequence
cacagccacagcucaaagc

SEQ ID NO: 5020 - RNA, 19 nt, artificial sequence
  siRNA Antisense Sequence
gcuuugagcuguggcugug

SEQ ID NO: 5021 - RNA, 19 nt, artificial sequence
  siRNA Sense Sequence
acagccacagcucaaagcg

SEQ ID NO: 5022 - RNA, 19 nt, artificial sequence
  siRNA Antisense Sequence
cgcuuugagcuguggcugu

SEQ ID NO: 5023 - RNA, 19 nt, artificial sequence
  siRNA Sense Sequence
cagccacagcucaaagcgg

SEQ ID NO: 5024 - RNA, 19 nt, artificial sequence
  siRNA Antisense Sequence
ccgcuuugagcuguggcug

SEQ ID NO: 5025 - RNA, 19 nt, artificial sequence
  siRNA Sense Sequence
agccacagcucaaagcggc

SEQ ID NO: 5026 - RNA, 19 nt, artificial sequence
  siRNA Antisense Sequence
gccgcuuugagcuguggcu

SEQ ID NO: 5027 - RNA, 19 nt, artificial sequence
  siRNA Sense Sequence
ggccaacugcugugaggag

SEQ ID NO: 5028 - RNA, 19 nt, artificial sequence
  siRNA Antisense Sequence
cuccucacagcaguuggcc

SEQ ID NO: 5029 - RNA, 19 nt, artificial sequence
  siRNA Sense Sequence
gccaacugcugugaggagg

SEQ ID NO: 5030 - RNA, 19 nt, artificial sequence
  siRNA Antisense Sequence
ccuccucacagcaguuggc

SEQ ID NO: 5031 - RNA, 19 nt, artificial sequence
  siRNA Sense Sequence
ccaacugcugugaggaggu

SEQ ID NO: 5032 - RNA, 19 nt, artificial sequence
  siRNA Antisense Sequence
accuccucacagcaguugg

SEQ ID NO: 5033 - RNA, 19 nt, artificial sequence
  siRNA Sense Sequence
caacugcugugaggaggug

SEQ ID NO: 5034 - RNA, 19 nt, artificial sequence
  siRNA Antisense Sequence
caccuccucacagcaguug

SEQ ID NO: 5035 - RNA, 19 nt, artificial sequence
  siRNA Sense Sequence
aacugcugugaggagguga

SEQ ID NO: 5036 - RNA, 19 nt, artificial sequence
  siRNA Antisense Sequence
ucaccuccucacagcaguu

SEQ ID NO: 5037 - RNA, 19 nt, artificial sequence
  siRNA Sense Sequence
acugcugugaggaggugaa

SEQ ID NO: 5038 - RNA, 19 nt, artificial sequence
  siRNA Antisense Sequence
uucaccuccucacagcagu

SEQ ID NO: 5039 - RNA, 19 nt, artificial sequence
  siRNA Sense Sequence
cucaaggcccaaguugcca

SEQ ID NO: 5040 - RNA, 19 nt, artificial sequence
  siRNA Antisense Sequence
uggcaacuugggccuugag

SEQ ID NO: 5041 - RNA, 19 nt, artificial sequence
  siRNA Sense Sequence
gcccaaguugccaaccuua

SEQ ID NO: 5042 - RNA, 19 nt, artificial sequence
  siRNA Antisense Sequence
uaagguuggcaacuugggc

SEQ ID NO: 5043 - RNA, 19 nt, artificial sequence
  siRNA Sense Sequence
cccaaguugccaaccuuag

SEQ ID NO: 5044 - RNA, 19 nt, artificial sequence
  siRNA Antisense Sequence
cuaagguuggcaacuuggg

SEQ ID NO: 5045 - RNA, 19 nt, artificial sequence
  siRNA Sense Sequence
ccaaguugccaaccuuagc

SEQ ID NO: 5046 - RNA, 19 nt, artificial sequence
  siRNA Antisense Sequence
gcuaagguuggcaacuugg

SEQ ID NO: 5047 - RNA, 19 nt, artificial sequence
  siRNA Sense Sequence
caaguugccaaccuuagca

SEQ ID NO: 5048 - RNA, 19 nt, artificial sequence
  siRNA Antisense Sequence
ugcuaagguuggcaacuug

SEQ ID NO: 5049 - RNA, 19 nt, artificial sequence
  siRNA Sense Sequence
aaguugccaaccuuagcag

SEQ ID NO: 5050 - RNA, 19 nt, artificial sequence
  siRNA Antisense Sequence
cugcuaagguuggcaacuu

SEQ ID NO: 5051 - RNA, 19 nt, artificial sequence
  siRNA Sense Sequence
aguugccaaccuuagcagc

SEQ ID NO: 5052 - RNA, 19 nt, artificial sequence
  siRNA Antisense Sequence
gcugcuaagguuggcaacu

SEQ ID NO: 5053 - RNA, 19 nt, artificial sequence
  siRNA Sense Sequence
gacugggucagcgugguca

SEQ ID NO: 5054 - RNA, 19 nt, artificial sequence
  siRNA Antisense Sequence
ugaccacgcugacccaguc

SEQ ID NO: 5055 - RNA, 19 nt, artificial sequence
  siRNA Sense Sequence
acugggucagcguggucau

SEQ ID NO: 5056 - RNA, 19 nt, artificial sequence
  siRNA Antisense Sequence
augaccacgcugacccagu

SEQ ID NO: 5057 - RNA, 19 nt, artificial sequence
  siRNA Sense Sequence
cugggucagcguggucaug

SEQ ID NO: 5058 - RNA, 19 nt, artificial sequence
  siRNA Antisense Sequence
caugaccacgcugacccag

SEQ ID NO: 5059 - RNA, 19 nt, artificial sequence
  siRNA Sense Sequence
ugggucagcguggucaugc

SEQ ID NO: 5060 - RNA, 19 nt, artificial sequence
  siRNA Antisense Sequence
gcaugaccacgcugaccca

SEQ ID NO: 5061 - RNA, 19 nt, artificial sequence
  siRNA Sense Sequence
gggucagcguggucaugca

SEQ ID NO: 5062 - RNA, 19 nt, artificial sequence
  siRNA Antisense Sequence
ugcaugaccacgcugaccc

SEQ ID NO: 5063 - RNA, 19 nt, artificial sequence
  siRNA Sense Sequence
cagcguggucaugcaggug

SEQ ID NO: 5064 - RNA, 19 nt, artificial sequence
  siRNA Antisense Sequence
caccugcaugaccacgcug

SEQ ID NO: 5065 - RNA, 19 nt, artificial sequence
  siRNA Sense Sequence
agcguggucaugcagguga

SEQ ID NO: 5066 - RNA, 19 nt, artificial sequence
  siRNA Antisense Sequence
ucaccugcaugaccacgcu

SEQ ID NO: 5067 - RNA, 19 nt, artificial sequence
  siRNA Sense Sequence
gcguggucaugcaggugau

SEQ ID NO: 5068 - RNA, 19 nt, artificial sequence
  siRNA Antisense Sequence
aucaccugcaugaccacgc

SEQ ID NO: 5069 - RNA, 19 nt, artificial sequence
  siRNA Sense Sequence
cguggucaugcaggugaug

SEQ ID NO: 5070 - RNA, 19 nt, artificial sequence
  siRNA Antisense Sequence
caucaccugcaugaccacg

SEQ ID NO: 5071 - RNA, 19 nt, artificial sequence
  siRNA Sense Sequence
agcaagcgcauggagucgc

SEQ ID NO: 5072 - RNA, 19 nt, artificial sequence
  siRNA Antisense Sequence
gcgacuccaugcgcuugcu

SEQ ID NO: 5073 - RNA, 19 nt, artificial sequence
  siRNA Sense Sequence
caaccaaauugacaucaug

SEQ ID NO: 5074 - RNA, 19 nt, artificial sequence
  siRNA Antisense Sequence
caugaugucaauuugguug

SEQ ID NO: 5075 - RNA, 19 nt, artificial sequence
  siRNA Sense Sequence
accaaauugacaucaugca

SEQ ID NO: 5076 - RNA, 19 nt, artificial sequence
  siRNA Antisense Sequence
ugcaugaugucaauuuggu

SEQ ID NO: 5077 - RNA, 19 nt, artificial sequence
  siRNA Sense Sequence
uugacaucaugcagcugca

SEQ ID NO: 5078 - RNA, 19 nt, artificial sequence
  siRNA Antisense Sequence
ugcagcugcaugaugucaa

SEQ ID NO: 5079 - RNA, 19 nt, artificial sequence
  siRNA Sense Sequence
caggcagcacagacgguca

SEQ ID NO: 5080 - RNA, 19 nt, artificial sequence
  siRNA Antisense Sequence
ugaccgucugugcugccug

SEQ ID NO: 5081 - RNA, 19 nt, artificial sequence
  siRNA Sense Sequence
aggcagcacagacggucac

SEQ ID NO: 5082 - RNA, 19 nt, artificial sequence
  siRNA Antisense Sequence
gugaccgucugugcugccu

SEQ ID NO: 5083 - RNA, 19 nt, artificial sequence
  siRNA Sense Sequence
ggcagcacagacggucacu

SEQ ID NO: 5084 - RNA, 19 nt, artificial sequence
  siRNA Antisense Sequence
agugaccgucugugcugcc

SEQ ID NO: 5085 - RNA, 19 nt, artificial sequence
  siRNA Sense Sequence
gcagcacagacggucacuc

SEQ ID NO: 5086 - RNA, 19 nt, artificial sequence
  siRNA Antisense Sequence
gagugaccgucugugcugc

SEQ ID NO: 5087 - RNA, 19 nt, artificial sequence
  siRNA Sense Sequence
gucacucagaccuccgcag

SEQ ID NO: 5088 - RNA, 19 nt, artificial sequence
  siRNA Antisense Sequence
cugcggaggucugagugac

SEQ ID NO: 5089 - RNA, 19 nt, artificial sequence
  siRNA Sense Sequence
ucacucagaccuccgcaga

SEQ ID NO: 5090 - RNA, 19 nt, artificial sequence
  siRNA Antisense Sequence
ucugcggaggucugaguga

SEQ ID NO: 5091 - RNA, 19 nt, artificial sequence
  siRNA Sense Sequence
cacucagaccuccgcagau

SEQ ID NO: 5092 - RNA, 19 nt, artificial sequence
  siRNA Antisense Sequence
aucugcggaggucugagug

SEQ ID NO: 5093 - RNA, 19 nt, artificial sequence
  siRNA Sense Sequence
acucagaccuccgcagaug

SEQ ID NO: 5094 - RNA, 19 nt, artificial sequence
  siRNA Antisense Sequence
caucugcggaggucugagu

SEQ ID NO: 5095 - RNA, 19 nt, artificial sequence
  siRNA Sense Sequence
cucagaccuccgcagaugc

SEQ ID NO: 5096 - RNA, 19 nt, artificial sequence
  siRNA Antisense Sequence
gcaucugcggaggucugag

SEQ ID NO: 5097 - RNA, 19 nt, artificial sequence
  siRNA Sense Sequence
ucagaccuccgcagaugcc

SEQ ID NO: 5098 - RNA, 19 nt, artificial sequence
  siRNA Antisense Sequence
ggcaucugcggaggucuga

SEQ ID NO: 5099 - RNA, 19 nt, artificial sequence
  siRNA Sense Sequence
cagaccuccgcagaugcca

SEQ ID NO: 5100 - RNA, 19 nt, artificial sequence
  siRNA Antisense Sequence
uggcaucugcggaggucug

SEQ ID NO: 5101 - RNA, 19 nt, artificial sequence
  siRNA Sense Sequence
gaugccaucuacgacugcu

SEQ ID NO: 5102 - RNA, 19 nt, artificial sequence
  siRNA Antisense Sequence
agcagucguagauggcauc

SEQ ID NO: 5103 - RNA, 19 nt, artificial sequence
  siRNA Sense Sequence
augccaucuacgacugcuc

SEQ ID NO: 5104 - RNA, 19 nt, artificial sequence
  siRNA Antisense Sequence
gagcagucguagauggcau

SEQ ID NO: 5105 - RNA, 19 nt, artificial sequence
  siRNA Sense Sequence
ugccaucuacgacugcucu

SEQ ID NO: 5106 - RNA, 19 nt, artificial sequence
  siRNA Antisense Sequence
agagcagucguagauggca

SEQ ID NO: 5107 - RNA, 19 nt, artificial sequence
  siRNA Sense Sequence
gccaucuacgacugcucuu

SEQ ID NO: 5108 - RNA, 19 nt, artificial sequence
  siRNA Antisense Sequence
aagagcagucguagauggc

SEQ ID NO: 5109 - RNA, 19 nt, artificial sequence
  siRNA Sense Sequence
ccaucuacgacugcucuuc

SEQ ID NO: 5110 - RNA, 19 nt, artificial sequence
  siRNA Antisense Sequence
gaagagcagucguagaugg

SEQ ID NO: 5111 - RNA, 19 nt, artificial sequence
  siRNA Sense Sequence
cuacgacugcucuucccuc

SEQ ID NO: 5112 - RNA, 19 nt, artificial sequence
  siRNA Antisense Sequence
gagggaagagcagucguag

SEQ ID NO: 5113 - RNA, 19 nt, artificial sequence
  siRNA Sense Sequence
uacgacugcucuucccucu

SEQ ID NO: 5114 - RNA, 19 nt, artificial sequence
  siRNA Antisense Sequence
agagggaagagcagucgua

SEQ ID NO: 5115 - RNA, 19 nt, artificial sequence
  siRNA Sense Sequence
aucucuggaguguauaagc

SEQ ID NO: 5116 - RNA, 19 nt, artificial sequence
  siRNA Antisense Sequence
gcuuauacacuccagagau

SEQ ID NO: 5117 - RNA, 19 nt, artificial sequence
  siRNA Sense Sequence
cuggaguguauaagcuucc

SEQ ID NO: 5118 - RNA, 19 nt, artificial sequence
  siRNA Antisense Sequence
ggaagcuuauacacuccag

SEQ ID NO: 5119 - RNA, 19 nt, artificial sequence
  siRNA Sense Sequence
uggaguguauaagcuuccu

SEQ ID NO: 5120 - RNA, 19 nt, artificial sequence
  siRNA Antisense Sequence
aggaagcuuauacacucca

SEQ ID NO: 5121 - RNA, 19 nt, artificial sequence
  siRNA Sense Sequence
ggaguguauaagcuuccuc

SEQ ID NO: 5122 - RNA, 19 nt, artificial sequence
  siRNA Antisense Sequence
gaggaagcuuauacacucc

SEQ ID NO: 5123 - RNA, 19 nt, artificial sequence
  siRNA Sense Sequence
guauaagcuuccuccugau

SEQ ID NO: 5124 - RNA, 19 nt, artificial sequence
  siRNA Antisense Sequence
aucaggaggaagcuuauac

SEQ ID NO: 5125 - RNA, 19 nt, artificial sequence
  siRNA Sense Sequence
uauaagcuuccuccugaug

SEQ ID NO: 5126 - RNA, 19 nt, artificial sequence
  siRNA Antisense Sequence
caucaggaggaagcuuaua

SEQ ID NO: 5127 - RNA, 19 nt, artificial sequence
  siRNA Sense Sequence
auaagcuuccuccugauga

SEQ ID NO: 5128 - RNA, 19 nt, artificial sequence
  siRNA Antisense Sequence
ucaucaggaggaagcuuau

SEQ ID NO: 5129 - RNA, 19 nt, artificial sequence
  siRNA Sense Sequence
aagcuuccuccugaugacu

SEQ ID NO: 5130 - RNA, 19 nt, artificial sequence
  siRNA Antisense Sequence
agucaucaggaggaagcuu

SEQ ID NO: 5131 - RNA, 19 nt, artificial sequence
  siRNA Sense Sequence
agcuuccuccugaugacuu

SEQ ID NO: 5132 - RNA, 19 nt, artificial sequence
  siRNA Antisense Sequence
aagucaucaggaggaagcu

SEQ ID NO: 5133 - RNA, 19 nt, artificial sequence
  siRNA Sense Sequence
gcuuccuccugaugacuuc

SEQ ID NO: 5134 - RNA, 19 nt, artificial sequence
  siRNA Antisense Sequence
gaagucaucaggaggaagc

SEQ ID NO: 5135 - RNA, 19 nt, artificial sequence
  siRNA Sense Sequence
cuuccuccugaugacuucc

SEQ ID NO: 5136 - RNA, 19 nt, artificial sequence
  siRNA Antisense Sequence
ggaagucaucaggaggaag

SEQ ID NO: 5137 - RNA, 19 nt, artificial sequence
  siRNA Sense Sequence
uuccuccugaugacuuccu

SEQ ID NO: 5138 - RNA, 19 nt, artificial sequence
  siRNA Antisense Sequence
aggaagucaucaggaggaa

SEQ ID NO: 5139 - RNA, 19 nt, artificial sequence
  siRNA Sense Sequence
acuuccugggcagcccuga

SEQ ID NO: 5140 - RNA, 19 nt, artificial sequence
  siRNA Antisense Sequence
ucagggcugcccaggaagu

SEQ ID NO: 5141 - RNA, 19 nt, artificial sequence
  siRNA Sense Sequence
agacuucaggcggaggcug

SEQ ID NO: 5142 - RNA, 19 nt, artificial sequence
  siRNA Antisense Sequence
cagccuccgccugaagucu

SEQ ID NO: 5143 - RNA, 19 nt, artificial sequence
  siRNA Sense Sequence
acuucaggcggaggcugga

SEQ ID NO: 5144 - RNA, 19 nt, artificial sequence
  siRNA Antisense Sequence
uccagccuccgccugaagu

SEQ ID NO: 5145 - RNA, 19 nt, artificial sequence
  siRNA Sense Sequence
gcggaggcuggaccaucau

SEQ ID NO: 5146 - RNA, 19 nt, artificial sequence
  siRNA Antisense Sequence
augaugguccagccuccgc

SEQ ID NO: 5147 - RNA, 19 nt, artificial sequence
  siRNA Sense Sequence
cggaggcuggaccaucauc

SEQ ID NO: 5148 - RNA, 19 nt, artificial sequence
  siRNA Antisense Sequence
gaugaugguccagccuccg

SEQ ID NO: 5149 - RNA, 19 nt, artificial sequence
  siRNA Sense Sequence
ggaggcuggaccaucaucc

SEQ ID NO: 5150 - RNA, 19 nt, artificial sequence
  siRNA Antisense Sequence
ggaugaugguccagccucc

SEQ ID NO: 5151 - RNA, 19 nt, artificial sequence
  siRNA Sense Sequence
aaguggccuugucuccuuc

SEQ ID NO: 5152 - RNA, 19 nt, artificial sequence
  siRNA Antisense Sequence
gaaggagacaaggccacuu

SEQ ID NO: 5153 - RNA, 19 nt, artificial sequence
  siRNA Sense Sequence
aguggccuugucuccuucu

SEQ ID NO: 5154 - RNA, 19 nt, artificial sequence
  siRNA Antisense Sequence
agaaggagacaaggccacu

SEQ ID NO: 5155 - RNA, 19 nt, artificial sequence
  siRNA Sense Sequence
guggccuugucuccuucua

SEQ ID NO: 5156 - RNA, 19 nt, artificial sequence
  siRNA Antisense Sequence
uagaaggagacaaggccac

SEQ ID NO: 5157 - RNA, 19 nt, artificial sequence
  siRNA Sense Sequence
cuugucuccuucuaccggg

SEQ ID NO: 5158 - RNA, 19 nt, artificial sequence
  siRNA Antisense Sequence
cccgguagaaggagacaag

SEQ ID NO: 5159 - RNA, 19 nt, artificial sequence
  siRNA Sense Sequence
uugucuccuucuaccggga

SEQ ID NO: 5160 - RNA, 19 nt, artificial sequence
  siRNA Antisense Sequence
ucccgguagaaggagacaa

SEQ ID NO: 5161 - RNA, 19 nt, artificial sequence
  siRNA Sense Sequence
ugucuccuucuaccgggac

SEQ ID NO: 5162 - RNA, 19 nt, artificial sequence
  siRNA Antisense Sequence
gucccgguagaaggagaca

SEQ ID NO: 5163 - RNA, 19 nt, artificial sequence
  siRNA Sense Sequence
gucuccuucuaccgggacu

SEQ ID NO: 5164 - RNA, 19 nt, artificial sequence
  siRNA Antisense Sequence
agucccgguagaaggagac

SEQ ID NO: 5165 - RNA, 19 nt, artificial sequence
  siRNA Sense Sequence
uucuaccgggacuggaagc

SEQ ID NO: 5166 - RNA, 19 nt, artificial sequence
  siRNA Antisense Sequence
gcuuccagucccgguagaa

SEQ ID NO: 5167 - RNA, 19 nt, artificial sequence
  siRNA Sense Sequence
ucuaccgggacuggaagca

SEQ ID NO: 5168 - RNA, 19 nt, artificial sequence
  siRNA Antisense Sequence
ugcuuccagucccgguaga

SEQ ID NO: 5169 - RNA, 19 nt, artificial sequence
  siRNA Sense Sequence
cuaccgggacuggaagcag

SEQ ID NO: 5170 - RNA, 19 nt, artificial sequence
  siRNA Antisense Sequence
cugcuuccagucccgguag

SEQ ID NO: 5171 - RNA, 19 nt, artificial sequence
  siRNA Sense Sequence
agcagggcuuuggcagcau

SEQ ID NO: 5172 - RNA, 19 nt, artificial sequence
  siRNA Antisense Sequence
augcugccaaagcccugcu

SEQ ID NO: 5173 - RNA, 19 nt, artificial sequence
  siRNA Sense Sequence
agggcuuuggcagcauccg

SEQ ID NO: 5174 - RNA, 19 nt, artificial sequence
  siRNA Antisense Sequence
cggaugcugccaaagcccu

SEQ ID NO: 5175 - RNA, 19 nt, artificial sequence
  siRNA Sense Sequence
gggcuuuggcagcauccgu

SEQ ID NO: 5176 - RNA, 19 nt, artificial sequence
  siRNA Antisense Sequence
acggaugcugccaaagccc

SEQ ID NO: 5177 - RNA, 19 nt, artificial sequence
  siRNA Sense Sequence
ggcuuuggcagcauccgug

SEQ ID NO: 5178 - RNA, 19 nt, artificial sequence
  siRNA Antisense Sequence
cacggaugcugccaaagcc

SEQ ID NO: 5179 - RNA, 19 nt, artificial sequence
  siRNA Sense Sequence
cauccaccggcucuccaga

SEQ ID NO: 5180 - RNA, 19 nt, artificial sequence
  siRNA Antisense Sequence
ucuggagagccgguggaug

SEQ ID NO: 5181 - RNA, 19 nt, artificial sequence
  siRNA Sense Sequence
auccaccggcucuccagac

SEQ ID NO: 5182 - RNA, 19 nt, artificial sequence
  siRNA Antisense Sequence
gucuggagagccgguggau

SEQ ID NO: 5183 - RNA, 19 nt, artificial sequence
  siRNA Sense Sequence
uccaccggcucuccagaca

SEQ ID NO: 5184 - RNA, 19 nt, artificial sequence
  siRNA Antisense Sequence
ugucuggagagccggugga

SEQ ID NO: 5185 - RNA, 19 nt, artificial sequence
  siRNA Sense Sequence
aggacugggagggcaaccu

SEQ ID NO: 5186 - RNA, 19 nt, artificial sequence
  siRNA Antisense Sequence
agguugcccucccaguccu

SEQ ID NO: 5187 - RNA, 19 nt, artificial sequence
  siRNA Sense Sequence
gcaaccugcgcuacgcuga

SEQ ID NO: 5188 - RNA, 19 nt, artificial sequence
  siRNA Antisense Sequence
ucagcguagcgcagguugc

SEQ ID NO: 5189 - RNA, 19 nt, artificial sequence
  siRNA Sense Sequence
caaccugcgcuacgcugag

SEQ ID NO: 5190 - RNA, 19 nt, artificial sequence
  siRNA Antisense Sequence
cucagcguagcgcagguug

SEQ ID NO: 5191 - RNA, 19 nt, artificial sequence
  siRNA Sense Sequence
cugcgcuacgcugaguaua

SEQ ID NO: 5192 - RNA, 19 nt, artificial sequence
  siRNA Antisense Sequence
uauacucagcguagcgcag

SEQ ID NO: 5193 - RNA, 19 nt, artificial sequence
  siRNA Sense Sequence
ugcgcuacgcugaguauag

SEQ ID NO: 5194 - RNA, 19 nt, artificial sequence
  siRNA Antisense Sequence
cuauacucagcguagcgca

SEQ ID NO: 5195 - RNA, 19 nt, artificial sequence
  siRNA Sense Sequence
cuacgcugaguauagccac

SEQ ID NO: 5196 - RNA, 19 nt, artificial sequence
  siRNA Antisense Sequence
guggcuauacucagcguag

SEQ ID NO: 5197 - RNA, 19 nt, artificial sequence
  siRNA Sense Sequence
uacgcugaguauagccacu

SEQ ID NO: 5198 - RNA, 19 nt, artificial sequence
  siRNA Antisense Sequence
aguggcuauacucagcgua

SEQ ID NO: 5199 - RNA, 19 nt, artificial sequence
  siRNA Sense Sequence
cacuuuguuuugggcaaug

SEQ ID NO: 5200 - RNA, 19 nt, artificial sequence
  siRNA Antisense Sequence
cauugcccaaaacaaagug

SEQ ID NO: 5201 - RNA, 19 nt, artificial sequence
  siRNA Sense Sequence
aacuacacuggcaaugugg

SEQ ID NO: 5202 - RNA, 19 nt, artificial sequence
  siRNA Antisense Sequence
ccacauugccaguguaguu

SEQ ID NO: 5203 - RNA, 19 nt, artificial sequence
  siRNA Sense Sequence
acuacacuggcaauguggg

SEQ ID NO: 5204 - RNA, 19 nt, artificial sequence
  siRNA Antisense Sequence
cccacauugccaguguagu

SEQ ID NO: 5205 - RNA, 19 nt, artificial sequence
  siRNA Sense Sequence
aacgacgcccuccaguauc

SEQ ID NO: 5206 - RNA, 19 nt, artificial sequence
  siRNA Antisense Sequence
gauacuggagggcgucguu

SEQ ID NO: 5207 - RNA, 19 nt, artificial sequence
  siRNA Sense Sequence
acgacgcccuccaguauca

SEQ ID NO: 5208 - RNA, 19 nt, artificial sequence
  siRNA Antisense Sequence
ugauacuggagggcgucgu

SEQ ID NO: 5209 - RNA, 19 nt, artificial sequence
  siRNA Sense Sequence
cgacgcccuccaguaucau

SEQ ID NO: 5210 - RNA, 19 nt, artificial sequence
  siRNA Antisense Sequence
augauacuggagggcgucg

SEQ ID NO: 5211 - RNA, 19 nt, artificial sequence
  siRNA Sense Sequence
gacgcccuccaguaucaua

SEQ ID NO: 5212 - RNA, 19 nt, artificial sequence
  siRNA Antisense Sequence
uaugauacuggagggcguc

SEQ ID NO: 5213 - RNA, 19 nt, artificial sequence
  siRNA Sense Sequence
acgcccuccaguaucauaa

SEQ ID NO: 5214 - RNA, 19 nt, artificial sequence
  siRNA Antisense Sequence
uuaugauacuggagggcgu

SEQ ID NO: 5215 - RNA, 19 nt, artificial sequence
  siRNA Sense Sequence
cgcccuccaguaucauaac

SEQ ID NO: 5216 - RNA, 19 nt, artificial sequence
  siRNA Antisense Sequence
guuaugauacuggagggcg

SEQ ID NO: 5217 - RNA, 19 nt, artificial sequence
  siRNA Sense Sequence
caagugugcacagcuccgc

SEQ ID NO: 5218 - RNA, 19 nt, artificial sequence
  siRNA Antisense Sequence
gcggagcugugcacacuug

SEQ ID NO: 5219 - RNA, 19 nt, artificial sequence
  siRNA Sense Sequence
aagugugcacagcuccgca

SEQ ID NO: 5220 - RNA, 19 nt, artificial sequence
  siRNA Antisense Sequence
ugcggagcugugcacacuu

SEQ ID NO: 5221 - RNA, 19 nt, artificial sequence
  siRNA Sense Sequence
agugugcacagcuccgcaa

SEQ ID NO: 5222 - RNA, 19 nt, artificial sequence
  siRNA Antisense Sequence
uugcggagcugugcacacu

SEQ ID NO: 5223 - RNA, 19 nt, artificial sequence
  siRNA Sense Sequence
ugcacagcuccgcaaaggu

SEQ ID NO: 5224 - RNA, 19 nt, artificial sequence
  siRNA Antisense Sequence
accuuugcggagcugugca

SEQ ID NO: 5225 - RNA, 19 nt, artificial sequence
  siRNA Sense Sequence
gcacagcuccgcaaaggug

SEQ ID NO: 5226 - RNA, 19 nt, artificial sequence
  siRNA Antisense Sequence
caccuuugcggagcugugc

SEQ ID NO: 5227 - RNA, 19 nt, artificial sequence
  siRNA Sense Sequence
cacagcuccgcaaaggugg

SEQ ID NO: 5228 - RNA, 19 nt, artificial sequence
  siRNA Antisense Sequence
ccaccuuugcggagcugug

SEQ ID NO: 5229 - RNA, 19 nt, artificial sequence
  siRNA Sense Sequence
acagcuccgcaaagguggc

SEQ ID NO: 5230 - RNA, 19 nt, artificial sequence
  siRNA Antisense Sequence
gccaccuuugcggagcugu

SEQ ID NO: 5231 - RNA, 19 nt, artificial sequence
  siRNA Sense Sequence
cagcuccgcaaagguggcu

SEQ ID NO: 5232 - RNA, 19 nt, artificial sequence
  siRNA Antisense Sequence
agccaccuuugcggagcug

SEQ ID NO: 5233 - RNA, 19 nt, artificial sequence
  siRNA Sense Sequence
agcuccgcaaagguggcua

SEQ ID NO: 5234 - RNA, 19 nt, artificial sequence
  siRNA Antisense Sequence
uagccaccuuugcggagcu

SEQ ID NO: 5235 - RNA, 19 nt, artificial sequence
  siRNA Sense Sequence
gcuccgcaaagguggcuac

SEQ ID NO: 5236 - RNA, 19 nt, artificial sequence
  siRNA Antisense Sequence
guagccaccuuugcggagc

SEQ ID NO: 5237 - RNA, 19 nt, artificial sequence
  siRNA Sense Sequence
cuccgcaaagguggcuacu

SEQ ID NO: 5238 - RNA, 19 nt, artificial sequence
  siRNA Antisense Sequence
aguagccaccuuugcggag

SEQ ID NO: 5239 - RNA, 19 nt, artificial sequence
  siRNA Sense Sequence
gcaaagguggcuacuggua

SEQ ID NO: 5240 - RNA, 19 nt, artificial sequence
  siRNA Antisense Sequence
uaccaguagccaccuuugc

SEQ ID NO: 5241 - RNA, 19 nt, artificial sequence
  siRNA Sense Sequence
caaagguggcuacugguac

SEQ ID NO: 5242 - RNA, 19 nt, artificial sequence
  siRNA Antisense Sequence
guaccaguagccaccuuug

SEQ ID NO: 5243 - RNA, 19 nt, artificial sequence
  siRNA Sense Sequence
aaagguggcuacugguaca

SEQ ID NO: 5244 - RNA, 19 nt, artificial sequence
  siRNA Antisense Sequence
uguaccaguagccaccuuu

SEQ ID NO: 5245 - RNA, 19 nt, artificial sequence
  siRNA Sense Sequence
caacugcugcacagacucc

SEQ ID NO: 5246 - RNA, 19 nt, artificial sequence
  siRNA Antisense Sequence
ggagucugugcagcaguug

SEQ ID NO: 5247 - RNA, 19 nt, artificial sequence
  siRNA Sense Sequence
cacagacuccaaccucaau

SEQ ID NO: 5248 - RNA, 19 nt, artificial sequence
  siRNA Antisense Sequence
auugagguuggagucugug

SEQ ID NO: 5249 - RNA, 19 nt, artificial sequence
  siRNA Sense Sequence
acagacuccaaccucaaug

SEQ ID NO: 5250 - RNA, 19 nt, artificial sequence
  siRNA Antisense Sequence
cauugagguuggagucugu

SEQ ID NO: 5251 - RNA, 19 nt, artificial sequence
  siRNA Sense Sequence
cagacuccaaccucaaugg

SEQ ID NO: 5252 - RNA, 19 nt, artificial sequence
  siRNA Antisense Sequence
ccauugagguuggagucug

SEQ ID NO: 5253 - RNA, 19 nt, artificial sequence
  siRNA Sense Sequence
ccaaccucaauggagugua

SEQ ID NO: 5254 - RNA, 19 nt, artificial sequence
  siRNA Antisense Sequence
uacacuccauugagguugg

SEQ ID NO: 5255 - RNA, 19 nt, artificial sequence
  siRNA Sense Sequence
caaccucaauggaguguac

SEQ ID NO: 5256 - RNA, 19 nt, artificial sequence
  siRNA Antisense Sequence
guacacuccauugagguug

SEQ ID NO: 5257 - RNA, 19 nt, artificial sequence
  siRNA Sense Sequence
aaccucaauggaguguacu

SEQ ID NO: 5258 - RNA, 19 nt, artificial sequence
  siRNA Antisense Sequence
aguacacuccauugagguu

SEQ ID NO: 5259 - RNA, 19 nt, artificial sequence
  siRNA Sense Sequence
accucaauggaguguacua

SEQ ID NO: 5260 - RNA, 19 nt, artificial sequence
  siRNA Antisense Sequence
uaguacacuccauugaggu

SEQ ID NO: 5261 - RNA, 19 nt, artificial sequence
  siRNA Sense Sequence
ccucaauggaguguacuac

SEQ ID NO: 5262 - RNA, 19 nt, artificial sequence
  siRNA Antisense Sequence
guaguacacuccauugagg

SEQ ID NO: 5263 - RNA, 19 nt, artificial sequence
  siRNA Sense Sequence
cucaauggaguguacuacc

SEQ ID NO: 5264 - RNA, 19 nt, artificial sequence
  siRNA Antisense Sequence
gguaguacacuccauugag

SEQ ID NO: 5265 - RNA, 19 nt, artificial sequence
  siRNA Sense Sequence
ucaauggaguguacuaccg

SEQ ID NO: 5266 - RNA, 19 nt, artificial sequence
  siRNA Antisense Sequence
cgguaguacacuccauuga

SEQ ID NO: 5267 - RNA, 19 nt, artificial sequence
  siRNA Sense Sequence
caauggaguguacuaccgc

SEQ ID NO: 5268 - RNA, 19 nt, artificial sequence
  siRNA Antisense Sequence
gcgguaguacacuccauug

SEQ ID NO: 5269 - RNA, 19 nt, artificial sequence
  siRNA Sense Sequence
aauggaguguacuaccgcc

SEQ ID NO: 5270 - RNA, 19 nt, artificial sequence
  siRNA Antisense Sequence
ggcgguaguacacuccauu

SEQ ID NO: 5271 - RNA, 19 nt, artificial sequence
  siRNA Sense Sequence
auggaguguacuaccgccu

SEQ ID NO: 5272 - RNA, 19 nt, artificial sequence
  siRNA Antisense Sequence
aggcgguaguacacuccau

SEQ ID NO: 5273 - RNA, 19 nt, artificial sequence
  siRNA Sense Sequence
uggaguguacuaccgccug

SEQ ID NO: 5274 - RNA, 19 nt, artificial sequence
  siRNA Antisense Sequence
caggcgguaguacacucca

SEQ ID NO: 5275 - RNA, 19 nt, artificial sequence
  siRNA Sense Sequence
ggaguguacuaccgccugg

SEQ ID NO: 5276 - RNA, 19 nt, artificial sequence
  siRNA Antisense Sequence
ccaggcgguaguacacucc

SEQ ID NO: 5277 - RNA, 19 nt, artificial sequence
  siRNA Sense Sequence
gaguguacuaccgccuggg

SEQ ID NO: 5278 - RNA, 19 nt, artificial sequence
  siRNA Antisense Sequence
cccaggcgguaguacacuc

SEQ ID NO: 5279 - RNA, 19 nt, artificial sequence
  siRNA Sense Sequence
aguguacuaccgccugggu

SEQ ID NO: 5280 - RNA, 19 nt, artificial sequence
  siRNA Antisense Sequence
acccaggcgguaguacacu

SEQ ID NO: 5281 - RNA, 19 nt, artificial sequence
  siRNA Sense Sequence
guacuaccgccugggugag

SEQ ID NO: 5282 - RNA, 19 nt, artificial sequence
  siRNA Antisense Sequence
cucacccaggcgguaguac

SEQ ID NO: 5283 - RNA, 19 nt, artificial sequence
  siRNA Sense Sequence
uacuaccgccugggugagc

SEQ ID NO: 5284 - RNA, 19 nt, artificial sequence
  siRNA Antisense Sequence
gcucacccaggcgguagua

SEQ ID NO: 5285 - RNA, 19 nt, artificial sequence
  siRNA Sense Sequence
acuaccgccugggugagca

SEQ ID NO: 5286 - RNA, 19 nt, artificial sequence
  siRNA Antisense Sequence
ugcucacccaggcgguagu

SEQ ID NO: 5287 - RNA, 19 nt, artificial sequence
  siRNA Sense Sequence
caauaagcaccuggauggc

SEQ ID NO: 5288 - RNA, 19 nt, artificial sequence
  siRNA Antisense Sequence
gccauccaggugcuuauug

SEQ ID NO: 5289 - RNA, 19 nt, artificial sequence
  siRNA Sense Sequence
aauaagcaccuggauggca

SEQ ID NO: 5290 - RNA, 19 nt, artificial sequence
  siRNA Antisense Sequence
ugccauccaggugcuuauu

SEQ ID NO: 5291 - RNA, 19 nt, artificial sequence
  siRNA Sense Sequence
auaagcaccuggauggcau

SEQ ID NO: 5292 - RNA, 19 nt, artificial sequence
  siRNA Antisense Sequence
augccauccaggugcuuau

SEQ ID NO: 5293 - RNA, 19 nt, artificial sequence
  siRNA Sense Sequence
uaagcaccuggauggcauc

SEQ ID NO: 5294 - RNA, 19 nt, artificial sequence
  siRNA Antisense Sequence
gaugccauccaggugcuua

SEQ ID NO: 5295 - RNA, 19 nt, artificial sequence
  siRNA Sense Sequence
aagcaccuggauggcauca

SEQ ID NO: 5296 - RNA, 19 nt, artificial sequence
  siRNA Antisense Sequence
ugaugccauccaggugcuu

SEQ ID NO: 5297 - RNA, 19 nt, artificial sequence
  siRNA Sense Sequence
agcaccuggauggcaucac

SEQ ID NO: 5298 - RNA, 19 nt, artificial sequence
  siRNA Antisense Sequence
gugaugccauccaggugcu

SEQ ID NO: 5299 - RNA, 19 nt, artificial sequence
  siRNA Sense Sequence
gcaccuggauggcaucacc

SEQ ID NO: 5300 - RNA, 19 nt, artificial sequence
  siRNA Antisense Sequence
ggugaugccauccaggugc

SEQ ID NO: 5301 - RNA, 19 nt, artificial sequence
  siRNA Sense Sequence
caccuggauggcaucaccu

SEQ ID NO: 5302 - RNA, 19 nt, artificial sequence
  siRNA Antisense Sequence
aggugaugccauccaggug

SEQ ID NO: 5303 - RNA, 19 nt, artificial sequence
  siRNA Sense Sequence
uggauggcaucaccuggua

SEQ ID NO: 5304 - RNA, 19 nt, artificial sequence
  siRNA Antisense Sequence
uaccaggugaugccaucca

SEQ ID NO: 5305 - RNA, 19 nt, artificial sequence
  siRNA Sense Sequence
uggcauggaucuaccuacu

SEQ ID NO: 5306 - RNA, 19 nt, artificial sequence
  siRNA Antisense Sequence
aguagguagauccaugcca

SEQ ID NO: 5307 - RNA, 19 nt, artificial sequence
  siRNA Sense Sequence
ggcauggaucuaccuacuc

SEQ ID NO: 5308 - RNA, 19 nt, artificial sequence
  siRNA Antisense Sequence
gaguagguagauccaugcc

SEQ ID NO: 5309 - RNA, 19 nt, artificial sequence
  siRNA Sense Sequence
gcauggaucuaccuacucc

SEQ ID NO: 5310 - RNA, 19 nt, artificial sequence
  siRNA Antisense Sequence
ggaguagguagauccaugc

SEQ ID NO: 5311 - RNA, 19 nt, artificial sequence
  siRNA Sense Sequence
cauggaucuaccuacuccc

SEQ ID NO: 5312 - RNA, 19 nt, artificial sequence
  siRNA Antisense Sequence
gggaguagguagauccaug

SEQ ID NO: 5313 - RNA, 19 nt, artificial sequence
  siRNA Sense Sequence
auggaucuaccuacucccu

SEQ ID NO: 5314 - RNA, 19 nt, artificial sequence
  siRNA Antisense Sequence
agggaguagguagauccau

SEQ ID NO: 5315 - RNA, 19 nt, artificial sequence
  siRNA Sense Sequence
uggaucuaccuacucccuc

SEQ ID NO: 5316 - RNA, 19 nt, artificial sequence
  siRNA Antisense Sequence
gagggaguagguagaucca

SEQ ID NO: 5317 - RNA, 19 nt, artificial sequence
  siRNA Sense Sequence
ggaucuaccuacucccuca

SEQ ID NO: 5318 - RNA, 19 nt, artificial sequence
  siRNA Antisense Sequence
ugagggaguagguagaucc

SEQ ID NO: 5319 - RNA, 19 nt, artificial sequence
  siRNA Sense Sequence
gaucuaccuacucccucaa

SEQ ID NO: 5320 - RNA, 19 nt, artificial sequence
  siRNA Antisense Sequence
uugagggaguagguagauc

SEQ ID NO: 5321 - RNA, 19 nt, artificial sequence
  siRNA Sense Sequence
aucuaccuacucccucaaa

SEQ ID NO: 5322 - RNA, 19 nt, artificial sequence
  siRNA Antisense Sequence
uuugagggaguagguagau

SEQ ID NO: 5323 - RNA, 19 nt, artificial sequence
  siRNA Sense Sequence
cgcccagaagacuucaagc

SEQ ID NO: 5324 - RNA, 19 nt, artificial sequence
  siRNA Antisense Sequence
gcuugaagucuucugggcg

SEQ ID NO: 5325 - RNA, 19 nt, artificial sequence
  siRNA Sense Sequence
gcccagaagacuucaagcc

SEQ ID NO: 5326 - RNA, 19 nt, artificial sequence
  siRNA Antisense Sequence
ggcuugaagucuucugggc

SEQ ID NO: 5327 - RNA, 19 nt, artificial sequence
  siRNA Sense Sequence
cccagaagacuucaagccu

SEQ ID NO: 5328 - RNA, 19 nt, artificial sequence
  siRNA Antisense Sequence
aggcuugaagucuucuggg

SEQ ID NO: 5329 - RNA, 19 nt, artificial sequence
  siRNA Sense Sequence
ccagaagacuucaagccuu

SEQ ID NO: 5330 - RNA, 19 nt, artificial sequence
  siRNA Antisense Sequence
aaggcuugaagucuucugg

SEQ ID NO: 5331 - RNA, 19 nt, artificial sequence
  siRNA Sense Sequence
cagaagacuucaagccuua

SEQ ID NO: 5332 - RNA, 19 nt, artificial sequence
  siRNA Antisense Sequence
uaaggcuugaagucuucug

SEQ ID NO: 5333 - RNA, 19 nt, artificial sequence
  siRNA Sense Sequence
gaagacuucaagccuuaaa

SEQ ID NO: 5334 - RNA, 19 nt, artificial sequence
  siRNA Antisense Sequence
uuuaaggcuugaagucuuc

SEQ ID NO: 5335 - RNA, 19 nt, artificial sequence
  siRNA Sense Sequence
aagacuucaagccuuaaaa

SEQ ID NO: 5336 - RNA, 19 nt, artificial sequence
  siRNA Antisense Sequence
uuuuaaggcuugaagucuu

SEQ ID NO: 5337 - RNA, 19 nt, artificial sequence
  siRNA Sense Sequence
agacuucaagccuuaaaag

SEQ ID NO: 5338 - RNA, 19 nt, artificial sequence
  siRNA Antisense Sequence
cuuuuaaggcuugaagucu

SEQ ID NO: 5339 - RNA, 19 nt, artificial sequence
  siRNA Sense Sequence
gacuucaagccuuaaaagg

SEQ ID NO: 5340 - RNA, 19 nt, artificial sequence
  siRNA Antisense Sequence
ccuuuuaaggcuugaaguc

SEQ ID NO: 5341 - RNA, 19 nt, artificial sequence
  siRNA Sense Sequence
acuucaagccuuaaaagga

SEQ ID NO: 5342 - RNA, 19 nt, artificial sequence
  siRNA Antisense Sequence
uccuuuuaaggcuugaagu

SEQ ID NO: 5343 - RNA, 19 nt, artificial sequence
  siRNA Sense Sequence
cuucaagccuuaaaaggag

SEQ ID NO: 5344 - RNA, 19 nt, artificial sequence
  siRNA Antisense Sequence
cuccuuuuaaggcuugaag

SEQ ID NO: 5345 - RNA, 19 nt, artificial sequence
  siRNA Sense Sequence
uucaagccuuaaaaggagg

SEQ ID NO: 5346 - RNA, 19 nt, artificial sequence
  siRNA Antisense Sequence
ccuccuuuuaaggcuugaa

SEQ ID NO: 5347 - RNA, 19 nt, artificial sequence
  siRNA Sense Sequence
ccuuaaaaggaggcugccg

SEQ ID NO: 5348 - RNA, 19 nt, artificial sequence
  siRNA Antisense Sequence
cggcagccuccuuuuaagg

SEQ ID NO: 5349 - RNA, 19 nt, artificial sequence
  siRNA Sense Sequence
cuuaaaaggaggcugccgu

SEQ ID NO: 5350 - RNA, 19 nt, artificial sequence
  siRNA Antisense Sequence
acggcagccuccuuuuaag

SEQ ID NO: 5351 - RNA, 19 nt, artificial sequence
  siRNA Sense Sequence
uuaaaaggaggcugccgug

SEQ ID NO: 5352 - RNA, 19 nt, artificial sequence
  siRNA Antisense Sequence
cacggcagccuccuuuuaa

SEQ ID NO: 5353 - RNA, 19 nt, artificial sequence
  siRNA Sense Sequence
uaaaaggaggcugccgugg

SEQ ID NO: 5354 - RNA, 19 nt, artificial sequence
  siRNA Antisense Sequence
ccacggcagccuccuuuua

SEQ ID NO: 5355 - RNA, 19 nt, artificial sequence
  siRNA Sense Sequence
aaaaggaggcugccgugga

SEQ ID NO: 5356 - RNA, 19 nt, artificial sequence
  siRNA Antisense Sequence
uccacggcagccuccuuuu

SEQ ID NO: 5357 - RNA, 19 nt, artificial sequence
  siRNA Sense Sequence
aaaggaggcugccguggag

SEQ ID NO: 5358 - RNA, 19 nt, artificial sequence
  siRNA Antisense Sequence
cuccacggcagccuccuuu

SEQ ID NO: 5359 - RNA, 19 nt, artificial sequence
  siRNA Sense Sequence
guggagcacggauacagaa

SEQ ID NO: 5360 - RNA, 19 nt, artificial sequence
  siRNA Antisense Sequence
uucuguauccgugcuccac

SEQ ID NO: 5361 - RNA, 19 nt, artificial sequence
  siRNA Sense Sequence
acuggaugagggcagauga

SEQ ID NO: 5362 - RNA, 19 nt, artificial sequence
  siRNA Antisense Sequence
ucaucugcccucauccagu

SEQ ID NO: 5363 - RNA, 19 nt, artificial sequence
  siRNA Sense Sequence
cuggaugagggcagaugag

SEQ ID NO: 5364 - RNA, 19 nt, artificial sequence
  siRNA Antisense Sequence
cucaucugcccucauccag

SEQ ID NO: 5365 - RNA, 19 nt, artificial sequence
  siRNA Sense Sequence
ggaugagggcagaugagga

SEQ ID NO: 5366 - RNA, 19 nt, artificial sequence
  siRNA Antisense Sequence
uccucaucugcccucaucc

SEQ ID NO: 5367 - RNA, 19 nt, artificial sequence
  siRNA Sense Sequence
augagggcagaugaggaca

SEQ ID NO: 5368 - RNA, 19 nt, artificial sequence
  siRNA Antisense Sequence
uguccucaucugcccucau

SEQ ID NO: 5369 - RNA, 19 nt, artificial sequence
  siRNA Sense Sequence
ugagggcagaugaggacag

SEQ ID NO: 5370 - RNA, 19 nt, artificial sequence
  siRNA Antisense Sequence
cuguccucaucugcccuca

SEQ ID NO: 5371 - RNA, 19 nt, artificial sequence
  siRNA Sense Sequence
agggcagaugaggacagga

SEQ ID NO: 5372 - RNA, 19 nt, artificial sequence
  siRNA Antisense Sequence
uccuguccucaucugcccu

SEQ ID NO: 5373 - RNA, 19 nt, artificial sequence
  siRNA Sense Sequence
ggcagaugaggacaggaag

SEQ ID NO: 5374 - RNA, 19 nt, artificial sequence
  siRNA Antisense Sequence
cuuccuguccucaucugcc

SEQ ID NO: 5375 - RNA, 19 nt, artificial sequence
  siRNA Sense Sequence
cagaugaggacaggaagag

SEQ ID NO: 5376 - RNA, 19 nt, artificial sequence
  siRNA Antisense Sequence
cucuuccuguccucaucug

SEQ ID NO: 5377 - RNA, 19 nt, artificial sequence
  siRNA Sense Sequence
gaauaagucuccaaggagc

SEQ ID NO: 5378 - RNA, 19 nt, artificial sequence
  siRNA Antisense Sequence
gcuccuuggagacuuauuc

SEQ ID NO: 5379 - RNA, 19 nt, artificial sequence
  siRNA Sense Sequence
aauaagucuccaaggagca

SEQ ID NO: 5380 - RNA, 19 nt, artificial sequence
  siRNA Antisense Sequence
ugcuccuuggagacuuauu

SEQ ID NO: 5381 - RNA, 19 nt, artificial sequence
  siRNA Sense Sequence
auaagucuccaaggagcac

SEQ ID NO: 5382 - RNA, 19 nt, artificial sequence
  siRNA Antisense Sequence
gugcuccuuggagacuuau

SEQ ID NO: 5383 - RNA, 19 nt, artificial sequence
  siRNA Sense Sequence
guaccaaggauguuacagu

SEQ ID NO: 5384 - RNA, 19 nt, artificial sequence
  siRNA Antisense Sequence
acuguaacauccuugguac

SEQ ID NO: 5385 - RNA, 19 nt, artificial sequence
  siRNA Sense Sequence
uaccaaggauguuacagua

SEQ ID NO: 5386 - RNA, 19 nt, artificial sequence
  siRNA Antisense Sequence
uacuguaacauccuuggua

SEQ ID NO: 5387 - RNA, 19 nt, artificial sequence
  siRNA Sense Sequence
accaaggauguuacaguaa

SEQ ID NO: 5388 - RNA, 19 nt, artificial sequence
  siRNA Antisense Sequence
uuacuguaacauccuuggu

SEQ ID NO: 5389 - RNA, 19 nt, artificial sequence
  siRNA Sense Sequence
ccaaggauguuacaguaaa

SEQ ID NO: 5390 - RNA, 19 nt, artificial sequence
  siRNA Antisense Sequence
uuuacuguaacauccuugg

SEQ ID NO: 5391 - RNA, 19 nt, artificial sequence
  siRNA Sense Sequence
cuggguccugccacauccu

SEQ ID NO: 5392 - RNA, 19 nt, artificial sequence
  siRNA Antisense Sequence
aggauguggcaggacccag

SEQ ID NO: 5393 - RNA, 19 nt, artificial sequence
  siRNA Sense Sequence
uggguccugccacauccuu

SEQ ID NO: 5394 - RNA, 19 nt, artificial sequence
  siRNA Antisense Sequence
aaggauguggcaggaccca

SEQ ID NO: 5395 - RNA, 19 nt, artificial sequence
  siRNA Sense Sequence
ggguccugccacauccuuc

SEQ ID NO: 5396 - RNA, 19 nt, artificial sequence
  siRNA Antisense Sequence
gaaggauguggcaggaccc

SEQ ID NO: 5397 - RNA, 19 nt, artificial sequence
  siRNA Sense Sequence
gguccugccacauccuucu

SEQ ID NO: 5398 - RNA, 19 nt, artificial sequence
  siRNA Antisense Sequence
agaaggauguggcaggacc

SEQ ID NO: 5399 - RNA, 19 nt, artificial sequence
  siRNA Sense Sequence
uccugccacauccuucuca

SEQ ID NO: 5400 - RNA, 19 nt, artificial sequence
  siRNA Antisense Sequence
ugagaaggauguggcagga

SEQ ID NO: 5401 - RNA, 19 nt, artificial sequence
  siRNA Sense Sequence
ccugccacauccuucucaa

SEQ ID NO: 5402 - RNA, 19 nt, artificial sequence
  siRNA Antisense Sequence
uugagaaggauguggcagg

SEQ ID NO: 5403 - RNA, 19 nt, artificial sequence
  siRNA Sense Sequence
cugccacauccuucucaag

SEQ ID NO: 5404 - RNA, 19 nt, artificial sequence
  siRNA Antisense Sequence
cuugagaaggauguggcag

SEQ ID NO: 5405 - RNA, 19 nt, artificial sequence
  siRNA Sense Sequence
cuucucaaggugguagacu

SEQ ID NO: 5406 - RNA, 19 nt, artificial sequence
  siRNA Antisense Sequence
agucuaccaccuugagaag

SEQ ID NO: 5407 - RNA, 19 nt, artificial sequence
  siRNA Sense Sequence
aggugguagacugaguggg

SEQ ID NO: 5408 - RNA, 19 nt, artificial sequence
  siRNA Antisense Sequence
cccacucagucuaccaccu

SEQ ID NO: 5409 - RNA, 19 nt, artificial sequence
  siRNA Sense Sequence
ggucucucugcccaagauc

SEQ ID NO: 5410 - RNA, 19 nt, artificial sequence
  siRNA Antisense Sequence
gaucuugggcagagagacc

SEQ ID NO: 5411 - RNA, 19 nt, artificial sequence
  siRNA Sense Sequence
gucucucugcccaagaucc

SEQ ID NO: 5412 - RNA, 19 nt, artificial sequence
  siRNA Antisense Sequence
ggaucuugggcagagagac

SEQ ID NO: 5413 - RNA, 19 nt, artificial sequence
  siRNA Sense Sequence
ucucucugcccaagauccc

SEQ ID NO: 5414 - RNA, 19 nt, artificial sequence
  siRNA Antisense Sequence
gggaucuugggcagagaga

SEQ ID NO: 5415 - RNA, 19 nt, artificial sequence
  siRNA Sense Sequence
ucugcccaagaucccugac

SEQ ID NO: 5416 - RNA, 19 nt, artificial sequence
  siRNA Antisense Sequence
gucagggaucuugggcaga

SEQ ID NO: 5417 - RNA, 19 nt, artificial sequence
  siRNA Sense Sequence
cugcccaagaucccugaca

SEQ ID NO: 5418 - RNA, 19 nt, artificial sequence
  siRNA Antisense Sequence
ugucagggaucuugggcag

SEQ ID NO: 5419 - RNA, 19 nt, artificial sequence
  siRNA Sense Sequence
ugcccaagaucccugacau

SEQ ID NO: 5420 - RNA, 19 nt, artificial sequence
  siRNA Antisense Sequence
augucagggaucuugggca

SEQ ID NO: 5421 - RNA, 19 nt, artificial sequence
  siRNA Sense Sequence
gcccaagaucccugacaua

SEQ ID NO: 5422 - RNA, 19 nt, artificial sequence
  siRNA Antisense Sequence
uaugucagggaucuugggc

SEQ ID NO: 5423 - RNA, 19 nt, artificial sequence
  siRNA Sense Sequence
cccaagaucccugacauag

SEQ ID NO: 5424 - RNA, 19 nt, artificial sequence
  siRNA Antisense Sequence
cuaugucagggaucuuggg

SEQ ID NO: 5425 - RNA, 19 nt, artificial sequence
  siRNA Sense Sequence
aucccugacauagcaguag

SEQ ID NO: 5426 - RNA, 19 nt, artificial sequence
  siRNA Antisense Sequence
cuacugcuaugucagggau

SEQ ID NO: 5427 - RNA, 19 nt, artificial sequence
  siRNA Sense Sequence
cccugacauagcaguagcu

SEQ ID NO: 5428 - RNA, 19 nt, artificial sequence
  siRNA Antisense Sequence
agcuacugcuaugucaggg

SEQ ID NO: 5429 - RNA, 19 nt, artificial sequence
  siRNA Sense Sequence
ccugacauagcaguagcuu

SEQ ID NO: 5430 - RNA, 19 nt, artificial sequence
  siRNA Antisense Sequence
aagcuacugcuaugucagg

SEQ ID NO: 5431 - RNA, 19 nt, artificial sequence
  siRNA Sense Sequence
cugacauagcaguagcuug

SEQ ID NO: 5432 - RNA, 19 nt, artificial sequence
  siRNA Antisense Sequence
caagcuacugcuaugucag

SEQ ID NO: 5433 - RNA, 19 nt, artificial sequence
  siRNA Sense Sequence
ugacauagcaguagcuugu

SEQ ID NO: 5434 - RNA, 19 nt, artificial sequence
  siRNA Antisense Sequence
acaagcuacugcuauguca

SEQ ID NO: 5435 - RNA, 19 nt, artificial sequence
  siRNA Sense Sequence
acauagcaguagcuugucu

SEQ ID NO: 5436 - RNA, 19 nt, artificial sequence
  siRNA Antisense Sequence
agacaagcuacugcuaugu

SEQ ID NO: 5437 - RNA, 19 nt, artificial sequence
  siRNA Sense Sequence
cauagcaguagcuugucuu

SEQ ID NO: 5438 - RNA, 19 nt, artificial sequence
  siRNA Antisense Sequence
aagacaagcuacugcuaug

SEQ ID NO: 5439 - RNA, 19 nt, artificial sequence
  siRNA Sense Sequence
gcaguagcuugucuuuucc

SEQ ID NO: 5440 - RNA, 19 nt, artificial sequence
  siRNA Antisense Sequence
ggaaaagacaagcuacugc

SEQ ID NO: 5441 - RNA, 19 nt, artificial sequence
  siRNA Sense Sequence
caguagcuugucuuuucca

SEQ ID NO: 5442 - RNA, 19 nt, artificial sequence
  siRNA Antisense Sequence
uggaaaagacaagcuacug

SEQ ID NO: 5443 - RNA, 19 nt, artificial sequence
  siRNA Sense Sequence
aguagcuugucuuuuccac

SEQ ID NO: 5444 - RNA, 19 nt, artificial sequence
  siRNA Antisense Sequence
guggaaaagacaagcuacu

SEQ ID NO: 5445 - RNA, 19 nt, artificial sequence
  siRNA Sense Sequence
guagcuugucuuuuccaca

SEQ ID NO: 5446 - RNA, 19 nt, artificial sequence
  siRNA Antisense Sequence
uguggaaaagacaagcuac

SEQ ID NO: 5447 - RNA, 19 nt, artificial sequence
  siRNA Sense Sequence
cuugucuuuuccacaugau

SEQ ID NO: 5448 - RNA, 19 nt, artificial sequence
  siRNA Antisense Sequence
aucauguggaaaagacaag

SEQ ID NO: 5449 - RNA, 19 nt, artificial sequence
  siRNA Sense Sequence
uugucuuuuccacaugauu

SEQ ID NO: 5450 - RNA, 19 nt, artificial sequence
  siRNA Antisense Sequence
aaucauguggaaaagacaa

SEQ ID NO: 5451 - RNA, 19 nt, artificial sequence
  siRNA Sense Sequence
cuuuuccacaugauuuguc

SEQ ID NO: 5452 - RNA, 19 nt, artificial sequence
  siRNA Antisense Sequence
gacaaaucauguggaaaag

SEQ ID NO: 5453 - RNA, 19 nt, artificial sequence
  siRNA Sense Sequence
uuuuccacaugauuugucu

SEQ ID NO: 5454 - RNA, 19 nt, artificial sequence
  siRNA Antisense Sequence
agacaaaucauguggaaaa

SEQ ID NO: 5455 - RNA, 19 nt, artificial sequence
  siRNA Sense Sequence
uuuccacaugauuugucug

SEQ ID NO: 5456 - RNA, 19 nt, artificial sequence
  siRNA Antisense Sequence
cagacaaaucauguggaaa

SEQ ID NO: 5457 - RNA, 19 nt, artificial sequence
  siRNA Sense Sequence
uuccacaugauuugucugu

SEQ ID NO: 5458 - RNA, 19 nt, artificial sequence
  siRNA Antisense Sequence
acagacaaaucauguggaa

SEQ ID NO: 5459 - RNA, 19 nt, artificial sequence
  siRNA Sense Sequence
gcuuaggcuaugugagggc

SEQ ID NO: 5460 - RNA, 19 nt, artificial sequence
  siRNA Antisense Sequence
gcccucacauagccuaagc

SEQ ID NO: 5461 - RNA, 19 nt, artificial sequence
  siRNA Sense Sequence
aggcuaugugagggcaaaa

SEQ ID NO: 5462 - RNA, 19 nt, artificial sequence
  siRNA Antisense Sequence
uuuugcccucacauagccu

SEQ ID NO: 5463 - RNA, 19 nt, artificial sequence
  siRNA Sense Sequence
aggagugaaggaggcaggu

SEQ ID NO: 5464 - RNA, 19 nt, artificial sequence
  siRNA Antisense Sequence
accugccuccuucacuccu

SEQ ID NO: 5465 - RNA, 19 nt, artificial sequence
  siRNA Sense Sequence
ggagugaaggaggcaggug

SEQ ID NO: 5466 - RNA, 19 nt, artificial sequence
  siRNA Antisense Sequence
caccugccuccuucacucc

SEQ ID NO: 5467 - RNA, 19 nt, artificial sequence
  siRNA Sense Sequence
gagugaaggaggcaggugg

SEQ ID NO: 5468 - RNA, 19 nt, artificial sequence
  siRNA Antisense Sequence
ccaccugccuccuucacuc

SEQ ID NO: 5469 - RNA, 19 nt, artificial sequence
  siRNA Sense Sequence
aauuaucuugagucuacac

SEQ ID NO: 5470 - RNA, 19 nt, artificial sequence
  siRNA Antisense Sequence
guguagacucaagauaauu

SEQ ID NO: 5471 - RNA, 19 nt, artificial sequence
  siRNA Sense Sequence
acuccagggcacugcaucu

SEQ ID NO: 5472 - RNA, 19 nt, artificial sequence
  siRNA Antisense Sequence
agaugcagugcccuggagu

SEQ ID NO: 5473 - RNA, 19 nt, artificial sequence
  siRNA Sense Sequence
cuccagggcacugcaucug

SEQ ID NO: 5474 - RNA, 19 nt, artificial sequence
  siRNA Antisense Sequence
cagaugcagugcccuggag

SEQ ID NO: 5475 - RNA, 19 nt, artificial sequence
  siRNA Sense Sequence
agggcacugcaucuggcga

SEQ ID NO: 5476 - RNA, 19 nt, artificial sequence
  siRNA Antisense Sequence
ucgccagaugcagugcccu

SEQ ID NO: 5477 - RNA, 19 nt, artificial sequence
  siRNA Sense Sequence
gggcacugcaucuggcgau

SEQ ID NO: 5478 - RNA, 19 nt, artificial sequence
  siRNA Antisense Sequence
aucgccagaugcagugccc

SEQ ID NO: 5479 - RNA, 19 nt, artificial sequence
  siRNA Sense Sequence
ggcacugcaucuggcgauc

SEQ ID NO: 5480 - RNA, 19 nt, artificial sequence
  siRNA Antisense Sequence
gaucgccagaugcagugcc

SEQ ID NO: 5481 - RNA, 19 nt, artificial sequence
  siRNA Sense Sequence
gcacugcaucuggcgauca

SEQ ID NO: 5482 - RNA, 19 nt, artificial sequence
  siRNA Antisense Sequence
ugaucgccagaugcagugc

SEQ ID NO: 5483 - RNA, 19 nt, artificial sequence
  siRNA Sense Sequence
cccugcucgccuuggucau

SEQ ID NO: 5484 - RNA, 19 nt, artificial sequence
  siRNA Antisense Sequence
augaccaaggcgagcaggg

SEQ ID NO: 5485 - RNA, 19 nt, artificial sequence
  siRNA Sense Sequence
ccugcucgccuuggucaug

SEQ ID NO: 5486 - RNA, 19 nt, artificial sequence
  siRNA Antisense Sequence
caugaccaaggcgagcagg

SEQ ID NO: 5487 - RNA, 19 nt, artificial sequence
  siRNA Sense Sequence
cugcucgccuuggucaugu

SEQ ID NO: 5488 - RNA, 19 nt, artificial sequence
  siRNA Antisense Sequence
acaugaccaaggcgagcag

SEQ ID NO: 5489 - RNA, 19 nt, artificial sequence
  siRNA Sense Sequence
ugcucgccuuggucaugua

SEQ ID NO: 5490 - RNA, 19 nt, artificial sequence
  siRNA Antisense Sequence
uacaugaccaaggcgagca

SEQ ID NO: 5491 - RNA, 19 nt, artificial sequence
  siRNA Sense Sequence
augaagcaccagcaggagg

SEQ ID NO: 5492 - RNA, 19 nt, artificial sequence
  siRNA Antisense Sequence
ccuccugcuggugcuucau

SEQ ID NO: 5493 - RNA, 19 nt, artificial sequence
  siRNA Sense Sequence
ugaagcaccagcaggaggu

SEQ ID NO: 5494 - RNA, 19 nt, artificial sequence
  siRNA Antisense Sequence
accuccugcuggugcuuca

SEQ ID NO: 5495 - RNA, 19 nt, artificial sequence
  siRNA Sense Sequence
cagcaggagguggacagag

SEQ ID NO: 5496 - RNA, 19 nt, artificial sequence
  siRNA Antisense Sequence
cucuguccaccuccugcug

SEQ ID NO: 5497 - RNA, 19 nt, artificial sequence
  siRNA Sense Sequence
agcaggagguggacagagu

SEQ ID NO: 5498 - RNA, 19 nt, artificial sequence
  siRNA Antisense Sequence
acucuguccaccuccugcu

SEQ ID NO: 5499 - RNA, 19 nt, artificial sequence
  siRNA Sense Sequence
gcaggagguggacagaguc

SEQ ID NO: 5500 - RNA, 19 nt, artificial sequence
  siRNA Antisense Sequence
gacucuguccaccuccugc

SEQ ID NO: 5501 - RNA, 19 nt, artificial sequence
  siRNA Sense Sequence
caggagguggacagagucu

SEQ ID NO: 5502 - RNA, 19 nt, artificial sequence
  siRNA Antisense Sequence
agacucuguccaccuccug

SEQ ID NO: 5503 - RNA, 19 nt, artificial sequence
  siRNA Sense Sequence
ggagguggacagagucucu

SEQ ID NO: 5504 - RNA, 19 nt, artificial sequence
  siRNA Antisense Sequence
agagacucuguccaccucc

SEQ ID NO: 5505 - RNA, 19 nt, artificial sequence
  siRNA Sense Sequence
agguggacagagucucuca

SEQ ID NO: 5506 - RNA, 19 nt, artificial sequence
  siRNA Antisense Sequence
ugagagacucuguccaccu

SEQ ID NO: 5507 - RNA, 19 nt, artificial sequence
  siRNA Sense Sequence
uggacagagucucucaugg

SEQ ID NO: 5508 - RNA, 19 nt, artificial sequence
  siRNA Antisense Sequence
ccaugagagacucugucca

SEQ ID NO: 5509 - RNA, 19 nt, artificial sequence
  siRNA Sense Sequence
ggacagagucucucaugga

SEQ ID NO: 5510 - RNA, 19 nt, artificial sequence
  siRNA Antisense Sequence
uccaugagagacucugucc

SEQ ID NO: 5511 - RNA, 19 nt, artificial sequence
  siRNA Sense Sequence
gacagagucucucauggau

SEQ ID NO: 5512 - RNA, 19 nt, artificial sequence
  siRNA Antisense Sequence
auccaugagagacucuguc

SEQ ID NO: 5513 - RNA, 19 nt, artificial sequence
  siRNA Sense Sequence
acagagucucucauggaug

SEQ ID NO: 5514 - RNA, 19 nt, artificial sequence
  siRNA Antisense Sequence
cauccaugagagacucugu

SEQ ID NO: 5515 - RNA, 19 nt, artificial sequence
  siRNA Sense Sequence
ggagcuuccuuuuaaauuu

SEQ ID NO: 5516 - RNA, 19 nt, artificial sequence
  siRNA Antisense Sequence
aaauuuaaaaggaagcucc

SEQ ID NO: 5517 - RNA, 19 nt, artificial sequence
  siRNA Sense Sequence
aacugaagguagauggugu

SEQ ID NO: 5518 - RNA, 19 nt, artificial sequence
  siRNA Antisense Sequence
acaccaucuaccuucaguu

SEQ ID NO: 5519 - RNA, 19 nt, artificial sequence
  siRNA Sense Sequence
acugaagguagaugguguu

SEQ ID NO: 5520 - RNA, 19 nt, artificial sequence
  siRNA Antisense Sequence
aacaccaucuaccuucagu

SEQ ID NO: 5521 - RNA, 19 nt, artificial sequence
  siRNA Sense Sequence
cugaagguagaugguguua

SEQ ID NO: 5522 - RNA, 19 nt, artificial sequence
  siRNA Antisense Sequence
uaacaccaucuaccuucag

SEQ ID NO: 5523 - RNA, 19 nt, artificial sequence
  siRNA Sense Sequence
ugaagguagaugguguuau

SEQ ID NO: 5524 - RNA, 19 nt, artificial sequence
  siRNA Antisense Sequence
auaacaccaucuaccuuca

SEQ ID NO: 5525 - RNA, 19 nt, artificial sequence
  siRNA Sense Sequence
gaagguagaugguguuaua

SEQ ID NO: 5526 - RNA, 19 nt, artificial sequence
  siRNA Antisense Sequence
uauaacaccaucuaccuuc

SEQ ID NO: 5527 - RNA, 19 nt, artificial sequence
  siRNA Sense Sequence
guagaugguguuauaguua

SEQ ID NO: 5528 - RNA, 19 nt, artificial sequence
  siRNA Antisense Sequence
uaacuauaacaccaucuac

SEQ ID NO: 5529 - RNA, 19 nt, artificial sequence
  siRNA Sense Sequence
uguaaauaagcaucucacu

SEQ ID NO: 5530 - RNA, 19 nt, artificial sequence
  siRNA Antisense Sequence
agugagaugcuuauuuaca

SEQ ID NO: 5531 - RNA, 19 nt, artificial sequence
  siRNA Sense Sequence
auaagcaucucacuuugua

SEQ ID NO: 5532 - RNA, 19 nt, artificial sequence
  siRNA Antisense Sequence
uacaaagugagaugcuuau

SEQ ID NO: 5533 - RNA, 21 nt, artificial sequence
  siRNA Sense Sequence
acacuuccuugugucuauaga

SEQ ID NO: 5534 - RNA, 23 nt, artificial sequence
  siRNA Antisense Sequence
ucuauagacacaaggaagugucg

SEQ ID NO: 5535 - RNA, 21 nt, artificial sequence
  siRNA Sense Sequence
guaccagaagaacuaccgaaa

SEQ ID NO: 5536 - RNA, 23 nt, artificial sequence
  siRNA Antisense Sequence
uuucgguaguucuucugguacag

SEQ ID NO: 5537 - RNA, 21 nt, artificial sequence
  siRNA Sense Sequence
uaccagaagaacuaccgaaua

SEQ ID NO: 5538 - RNA, 23 nt, artificial sequence
  siRNA Antisense Sequence
uauucgguaguucuucugguaca

SEQ ID NO: 5539 - RNA, 21 nt, artificial sequence
  siRNA Sense Sequence
cugugacauggaaacuucaga

SEQ ID NO: 5540 - RNA, 23 nt, artificial sequence
  siRNA Antisense Sequence
ucugaaguuuccaugucacagaa

SEQ ID NO: 5541 - RNA, 21 nt, artificial sequence
  siRNA Sense Sequence
cagaagaacuaccgaaucuca

SEQ ID NO: 5542 - RNA, 23 nt, artificial sequence
  siRNA Antisense Sequence
ugagauucgguaguucuucuggu

SEQ ID NO: 5543 - RNA, 21 nt, artificial sequence
  siRNA Sense Sequence
agaagaacuaccgaaucucua

SEQ ID NO: 5544 - RNA, 23 nt, artificial sequence
  siRNA Antisense Sequence
uagagauucgguaguucuucugg

SEQ ID NO: 5545 - RNA, 21 nt, artificial sequence
  siRNA Sense Sequence
gacaguauaagcaaggguuua

SEQ ID NO: 5546 - RNA, 23 nt, artificial sequence
  siRNA Antisense Sequence
uaaacccuugcuuauacugucuc

SEQ ID NO: 5547 - RNA, 21 nt, artificial sequence
  siRNA Sense Sequence
gaagaacuaccgaaucucuga

SEQ ID NO: 5548 - RNA, 23 nt, artificial sequence
  siRNA Antisense Sequence
ucagagauucgguaguucuucug

SEQ ID NO: 5549 - RNA, 21 nt, artificial sequence
  siRNA Sense Sequence
ugugacauggaaacuucagga

SEQ ID NO: 5550 - RNA, 23 nt, artificial sequence
  siRNA Antisense Sequence
uccugaaguuuccaugucacaga

SEQ ID NO: 5551 - RNA, 21 nt, artificial sequence
  siRNA Sense Sequence
gucuccuucuaccaagacuga

SEQ ID NO: 5552 - RNA, 23 nt, artificial sequence
  siRNA Antisense Sequence
ucagucuugguagaaggagacaa

SEQ ID NO: 5553 - RNA, 21 nt, artificial sequence
  siRNA Sense Sequence
acucugagaugaacaaccaga

SEQ ID NO: 5554 - RNA, 23 nt, artificial sequence
  siRNA Antisense Sequence
ucugguuguucaucucagaguac

SEQ ID NO: 5555 - RNA, 21 nt, artificial sequence
  siRNA Sense Sequence
agacaguauaagcaaggguua

SEQ ID NO: 5556 - RNA, 23 nt, artificial sequence
  siRNA Antisense Sequence
uaacccuugcuuauacugucucc

SEQ ID NO: 5557 - RNA, 21 nt, artificial sequence
  siRNA Sense Sequence
acaguauaagcaaggguuuga

SEQ ID NO: 5558 - RNA, 23 nt, artificial sequence
  siRNA Antisense Sequence
ucaaacccuugcuuauacugucu

SEQ ID NO: 5559 - RNA, 21 nt, artificial sequence
  siRNA Sense Sequence
uugggcaaugaacugaacaga

SEQ ID NO: 5560 - RNA, 23 nt, artificial sequence
  siRNA Antisense Sequence
ucuguucaguucauugcccaacg

SEQ ID NO: 5561 - RNA, 21 nt, artificial sequence
  siRNA Sense Sequence
gccaacuauucccucaaacga

SEQ ID NO: 5562 - RNA, 23 nt, artificial sequence
  siRNA Antisense Sequence
ucguuugagggaauaguuggcuc

SEQ ID NO: 5563 - RNA, 21 nt, artificial sequence
  siRNA Sense Sequence
ccgagagcaaguacucugaga

SEQ ID NO: 5564 - RNA, 23 nt, artificial sequence
  siRNA Antisense Sequence
ucucagaguacuugcucucggca

SEQ ID NO: 5565 - RNA, 21 nt, artificial sequence
  siRNA Sense Sequence
cauaacaacaccgucuucaga

SEQ ID NO: 5566 - RNA, 23 nt, artificial sequence
  siRNA Antisense Sequence
ucugaagacgguguuguuauggu

SEQ ID NO: 5567 - RNA, 21 nt, artificial sequence
  siRNA Sense Sequence
uguaccagaagaacuaccgaa

SEQ ID NO: 5568 - RNA, 23 nt, artificial sequence
  siRNA Antisense Sequence
uucgguaguucuucugguacagg

SEQ ID NO: 5569 - RNA, 21 nt, artificial sequence
  siRNA Sense Sequence
ugacauggaaacuucaggaga

SEQ ID NO: 5570 - RNA, 23 nt, artificial sequence
  siRNA Antisense Sequence
ucuccugaaguuuccaugucaca

SEQ ID NO: 5571 - RNA, 21 nt, artificial sequence
  siRNA Sense Sequence
cugcagaagccucauaaacga

SEQ ID NO: 5572 - RNA, 23 nt, artificial sequence
  siRNA Antisense Sequence
ucguuuaugaggcuucugcagcc

SEQ ID NO: 5573 - RNA, 21 nt, artificial sequence
  siRNA Sense Sequence
gcagaagccucauaaacgcaa

SEQ ID NO: 5574 - RNA, 23 nt, artificial sequence
  siRNA Antisense Sequence
uugcguuuaugaggcuucugcag

SEQ ID NO: 5575 - RNA, 21 nt, artificial sequence
  siRNA Sense Sequence
ugccgagagcaaguacucuga

SEQ ID NO: 5576 - RNA, 23 nt, artificial sequence
  siRNA Antisense Sequence
ucagaguacuugcucucggcagu

SEQ ID NO: 5577 - RNA, 21 nt, artificial sequence
  siRNA Sense Sequence
cuuggaaggaaagcuauaggu

SEQ ID NO: 5578 - RNA, 23 nt, artificial sequence
  siRNA Antisense Sequence
accuauagcuuuccuuccaagcc

SEQ ID NO: 5579 - RNA, 21 nt, artificial sequence
  siRNA Sense Sequence
uauaggcuacccauucagcuu

SEQ ID NO: 5580 - RNA, 23 nt, artificial sequence
  siRNA Antisense Sequence
aagcugaauggguagccuauagc

SEQ ID NO: 5581 - RNA, 21 nt, artificial sequence
  siRNA Sense Sequence
gagacucaagcuuugagaaau

SEQ ID NO: 5582 - RNA, 23 nt, artificial sequence
  siRNA Antisense Sequence
auuucucaaagcuugagucucug

SEQ ID NO: 5583 - RNA, 21 nt, artificial sequence
  siRNA Sense Sequence
gcuagcaaagagcaaggaaau

SEQ ID NO: 5584 - RNA, 23 nt, artificial sequence
  siRNA Antisense Sequence
auuuccuugcucuuugcuagccu

SEQ ID NO: 5585 - RNA, 21 nt, artificial sequence
  siRNA Sense Sequence
aagagagaaaacaacaaaguu

SEQ ID NO: 5586 - RNA, 23 nt, artificial sequence
  siRNA Antisense Sequence
aacuuuguuguuuucucucuuuc

SEQ ID NO: 5587 - RNA, 21 nt, artificial sequence
  siRNA Sense Sequence
guggcgaggcccucagagugu

SEQ ID NO: 5588 - RNA, 23 nt, artificial sequence
  siRNA Antisense Sequence
acacucugagggccucgccacuu

SEQ ID NO: 5589 - RNA, 21 nt, artificial sequence
  siRNA Sense Sequence
cagagugaaagcguaagguuu

SEQ ID NO: 5590 - RNA, 23 nt, artificial sequence
  siRNA Antisense Sequence
aaaccuuacgcuuucacucugag

SEQ ID NO: 5591 - RNA, 21 nt, artificial sequence
  siRNA Sense Sequence
cguaagguucagucagccugu

SEQ ID NO: 5592 - RNA, 23 nt, artificial sequence
  siRNA Antisense Sequence
acaggcugacugaaccuuacgcu

SEQ ID NO: 5593 - RNA, 21 nt, artificial sequence
  siRNA Sense Sequence
cugcagcuuugcagaccucau

SEQ ID NO: 5594 - RNA, 23 nt, artificial sequence
  siRNA Antisense Sequence
augaggucugcaaagcugcagca

SEQ ID NO: 5595 - RNA, 21 nt, artificial sequence
  siRNA Sense Sequence
cucagcugggcaucuccagau

SEQ ID NO: 5596 - RNA, 23 nt, artificial sequence
  siRNA Antisense Sequence
aucuggagaugcccagcugaggu

SEQ ID NO: 5597 - RNA, 21 nt, artificial sequence
  siRNA Sense Sequence
ugaaggaagagccuuccucau

SEQ ID NO: 5598 - RNA, 23 nt, artificial sequence
  siRNA Antisense Sequence
augaggaaggcucuuccuucagg

SEQ ID NO: 5599 - RNA, 21 nt, artificial sequence
  siRNA Sense Sequence
cacccaaacccacaaaagauu

SEQ ID NO: 5600 - RNA, 23 nt, artificial sequence
  siRNA Antisense Sequence
aaucuuuuguggguuugggugag

SEQ ID NO: 5601 - RNA, 21 nt, artificial sequence
  siRNA Sense Sequence
gccucucucagcugugaccuu

SEQ ID NO: 5602 - RNA, 23 nt, artificial sequence
  siRNA Antisense Sequence
aaggucacagcugagagaggcuu

SEQ ID NO: 5603 - RNA, 21 nt, artificial sequence
  siRNA Sense Sequence
uggcucugcauuuucaucguu

SEQ ID NO: 5604 - RNA, 23 nt, artificial sequence
  siRNA Antisense Sequence
aacgaugaaaaugcagagccagg

SEQ ID NO: 5605 - RNA, 21 nt, artificial sequence
  siRNA Sense Sequence
uuucaucguggccuuugucau

SEQ ID NO: 5606 - RNA, 23 nt, artificial sequence
  siRNA Antisense Sequence
augacaaaggccacgaugaaaau

SEQ ID NO: 5607 - RNA, 21 nt, artificial sequence
  siRNA Sense Sequence
cugcagaagcucucuaagcau

SEQ ID NO: 5608 - RNA, 23 nt, artificial sequence
  siRNA Antisense Sequence
augcuuagagagcuucugcagcc

SEQ ID NO: 5609 - RNA, 21 nt, artificial sequence
  siRNA Sense Sequence
aagcacaagacaccagcacau

SEQ ID NO: 5610 - RNA, 23 nt, artificial sequence
  siRNA Antisense Sequence
augugcuggugucuugugcuuag

SEQ ID NO: 5611 - RNA, 21 nt, artificial sequence
  siRNA Sense Sequence
ccagcacagccacagcucaau

SEQ ID NO: 5612 - RNA, 23 nt, artificial sequence
  siRNA Antisense Sequence
auugagcuguggcugugcuggug

SEQ ID NO: 5613 - RNA, 21 nt, artificial sequence
  siRNA Sense Sequence
cagcucaaagcggccaacugu

SEQ ID NO: 5614 - RNA, 23 nt, artificial sequence
  siRNA Antisense Sequence
acaguuggccgcuuugagcugug

SEQ ID NO: 5615 - RNA, 21 nt, artificial sequence
  siRNA Sense Sequence
gccaacugcugugaggagguu

SEQ ID NO: 5616 - RNA, 23 nt, artificial sequence
  siRNA Antisense Sequence
aaccuccucacagcaguuggccg

SEQ ID NO: 5617 - RNA, 21 nt, artificial sequence
  siRNA Sense Sequence
gaggaggugaaggagcucaau

SEQ ID NO: 5618 - RNA, 23 nt, artificial sequence
  siRNA Antisense Sequence
auugagcuccuucaccuccucac

SEQ ID NO: 5619 - RNA, 21 nt, artificial sequence
  siRNA Sense Sequence
ggagcucaaggcccaaguugu

SEQ ID NO: 5620 - RNA, 23 nt, artificial sequence
  siRNA Antisense Sequence
acaacuugggccuugagcuccuu

SEQ ID NO: 5621 - RNA, 21 nt, artificial sequence
  siRNA Sense Sequence
ccaaguugccaaccuuagcau

SEQ ID NO: 5622 - RNA, 23 nt, artificial sequence
  siRNA Antisense Sequence
augcuaagguuggcaacuugggc

SEQ ID NO: 5623 - RNA, 21 nt, artificial sequence
  siRNA Sense Sequence
cuuagcagccugcugagugau

SEQ ID NO: 5624 - RNA, 23 nt, artificial sequence
  siRNA Antisense Sequence
aucacucagcaggcugcuaaggu

SEQ ID NO: 5625 - RNA, 21 nt, artificial sequence
  siRNA Sense Sequence
gcugagugaacugaacaagau

SEQ ID NO: 5626 - RNA, 23 nt, artificial sequence
  siRNA Antisense Sequence
aucuuguucaguucacucagcag

SEQ ID NO: 5627 - RNA, 21 nt, artificial sequence
  siRNA Sense Sequence
ugaacaagaagcaggagaggu

SEQ ID NO: 5628 - RNA, 23 nt, artificial sequence
  siRNA Antisense Sequence
accucuccugcuucuuguucagu

SEQ ID NO: 5629 - RNA, 21 nt, artificial sequence
  siRNA Sense Sequence
gacugggucagcguggucauu

SEQ ID NO: 5630 - RNA, 23 nt, artificial sequence
  siRNA Antisense Sequence
aaugaccacgcugacccaguccc

SEQ ID NO: 5631 - RNA, 21 nt, artificial sequence
  siRNA Sense Sequence
guggucaugcaggugauggau

SEQ ID NO: 5632 - RNA, 23 nt, artificial sequence
  siRNA Antisense Sequence
auccaucaccugcaugaccacgc

SEQ ID NO: 5633 - RNA, 21 nt, artificial sequence
  siRNA Sense Sequence
gugauggagcuggagagcaau

SEQ ID NO: 5634 - RNA, 23 nt, artificial sequence
  siRNA Antisense Sequence
auugcucuccagcuccaucaccu

SEQ ID NO: 5635 - RNA, 21 nt, artificial sequence
  siRNA Sense Sequence
ggagagcaacagcaagcgcau

SEQ ID NO: 5636 - RNA, 23 nt, artificial sequence
  siRNA Antisense Sequence
augcgcuugcuguugcucuccag

SEQ ID NO: 5637 - RNA, 21 nt, artificial sequence
  siRNA Sense Sequence
auggagucgcggcucacagau

SEQ ID NO: 5638 - RNA, 23 nt, artificial sequence
  siRNA Antisense Sequence
aucugugagccgcgacuccaugc

SEQ ID NO: 5639 - RNA, 21 nt, artificial sequence
  siRNA Sense Sequence
cucacagaugcugagagcaau

SEQ ID NO: 5640 - RNA, 23 nt, artificial sequence
  siRNA Antisense Sequence
auugcucucagcaucugugagcc

SEQ ID NO: 5641 - RNA, 21 nt, artificial sequence
  siRNA Sense Sequence
gagcaaguacuccgagaugau

SEQ ID NO: 5642 - RNA, 23 nt, artificial sequence
  siRNA Antisense Sequence
aucaucucggaguacuugcucuc

SEQ ID NO: 5643 - RNA, 21 nt, artificial sequence
  siRNA Sense Sequence
cgagaugaacaaccaaauugu

SEQ ID NO: 5644 - RNA, 23 nt, artificial sequence
  siRNA Antisense Sequence
acaauuugguuguucaucucgga

SEQ ID NO: 5645 - RNA, 21 nt, artificial sequence
  siRNA Sense Sequence
accaaauugacaucaugcagu

SEQ ID NO: 5646 - RNA, 23 nt, artificial sequence
  siRNA Antisense Sequence
acugcaugaugucaauuugguug

SEQ ID NO: 5647 - RNA, 21 nt, artificial sequence
  siRNA Sense Sequence
cagcugcaggcagcacagacu

SEQ ID NO: 5648 - RNA, 23 nt, artificial sequence
  siRNA Antisense Sequence
agucugugcugccugcagcugca

SEQ ID NO: 5649 - RNA, 21 nt, artificial sequence
  siRNA Sense Sequence
agcacagacggucacucagau

SEQ ID NO: 5650 - RNA, 23 nt, artificial sequence
  siRNA Antisense Sequence
aucugagugaccgucugugcugc

SEQ ID NO: 5651 - RNA, 21 nt, artificial sequence
  siRNA Sense Sequence
ucacucagaccuccgcagauu

SEQ ID NO: 5652 - RNA, 23 nt, artificial sequence
  siRNA Antisense Sequence
aaucugcggaggucugagugacc

SEQ ID NO: 5653 - RNA, 21 nt, artificial sequence
  siRNA Sense Sequence
cgcagaugccaucuacgacuu

SEQ ID NO: 5654 - RNA, 23 nt, artificial sequence
  siRNA Antisense Sequence
aagucguagauggcaucugcgga

SEQ ID NO: 5655 - RNA, 21 nt, artificial sequence
  siRNA Sense Sequence
uacgacugcucuucccucuau

SEQ ID NO: 5656 - RNA, 23 nt, artificial sequence
  siRNA Antisense Sequence
auagagggaagagcagucguaga

SEQ ID NO: 5657 - RNA, 21 nt, artificial sequence
  siRNA Sense Sequence
ucccucuaccagaagaacuau

SEQ ID NO: 5658 - RNA, 23 nt, artificial sequence
  siRNA Antisense Sequence
auaguucuucugguagagggaag

SEQ ID NO: 5659 - RNA, 21 nt, artificial sequence
  siRNA Sense Sequence
gaagaacuaccgcaucucugu

SEQ ID NO: 5660 - RNA, 23 nt, artificial sequence
  siRNA Antisense Sequence
acagagaugcgguaguucuucug

SEQ ID NO: 5661 - RNA, 21 nt, artificial sequence
  siRNA Sense Sequence
ucucuggaguguauaagcuuu

SEQ ID NO: 5662 - RNA, 23 nt, artificial sequence
  siRNA Antisense Sequence
aaagcuuauacacuccagagaug

SEQ ID NO: 5663 - RNA, 21 nt, artificial sequence
  siRNA Sense Sequence
cuuccuccugaugacuuccuu

SEQ ID NO: 5664 - RNA, 23 nt, artificial sequence
  siRNA Antisense Sequence
aaggaagucaucaggaggaagcu

SEQ ID NO: 5665 - RNA, 21 nt, artificial sequence
  siRNA Sense Sequence
agcccugaacuggagguguuu

SEQ ID NO: 5666 - RNA, 23 nt, artificial sequence
  siRNA Antisense Sequence
aaacaccuccaguucagggcugc

SEQ ID NO: 5667 - RNA, 21 nt, artificial sequence
  siRNA Sense Sequence
ggagguguucugugacauggu

SEQ ID NO: 5668 - RNA, 23 nt, artificial sequence
  siRNA Antisense Sequence
accaugucacagaacaccuccag

SEQ ID NO: 5669 - RNA, 21 nt, artificial sequence
  siRNA Sense Sequence
gugacauggagacuucaggcu

SEQ ID NO: 5670 - RNA, 23 nt, artificial sequence
  siRNA Antisense Sequence
agccugaagucuccaugucacag

SEQ ID NO: 5671 - RNA, 21 nt, artificial sequence
  siRNA Sense Sequence
ucaggcggaggcuggaccauu

SEQ ID NO: 5672 - RNA, 23 nt, artificial sequence
  siRNA Antisense Sequence
aaugguccagccuccgccugaag

SEQ ID NO: 5673 - RNA, 21 nt, artificial sequence
  siRNA Sense Sequence
gaccaucauccagagacgaau

SEQ ID NO: 5674 - RNA, 23 nt, artificial sequence
  siRNA Antisense Sequence
auucgucucuggaugauggucca

SEQ ID NO: 5675 - RNA, 21 nt, artificial sequence
  siRNA Sense Sequence
guggccuugucuccuucuacu

SEQ ID NO: 5676 - RNA, 23 nt, artificial sequence
  siRNA Antisense Sequence
aguagaaggagacaaggccacuu

SEQ ID NO: 5677 - RNA, 21 nt, artificial sequence
  siRNA Sense Sequence
uccuucuaccgggacuggaau

SEQ ID NO: 5678 - RNA, 23 nt, artificial sequence
  siRNA Antisense Sequence
auuccagucccgguagaaggaga

SEQ ID NO: 5679 - RNA, 21 nt, artificial sequence
  siRNA Sense Sequence
ggacuggaagcaguacaagcu

SEQ ID NO: 5680 - RNA, 23 nt, artificial sequence
  siRNA Antisense Sequence
agcuuguacugcuuccagucccg

SEQ ID NO: 5681 - RNA, 21 nt, artificial sequence
  siRNA Sense Sequence
gggcuuuggcagcauccgugu

SEQ ID NO: 5682 - RNA, 23 nt, artificial sequence
  siRNA Antisense Sequence
acacggaugcugccaaagcccug

SEQ ID NO: 5683 - RNA, 21 nt, artificial sequence
  siRNA Sense Sequence
aacgaacacauccaccggcuu

SEQ ID NO: 5684 - RNA, 23 nt, artificial sequence
  siRNA Antisense Sequence
aagccgguggauguguucguucc

SEQ ID NO: 5685 - RNA, 21 nt, artificial sequence
  siRNA Sense Sequence
ccggcucuccagacagccaau

SEQ ID NO: 5686 - RNA, 23 nt, artificial sequence
  siRNA Antisense Sequence
auuggcugucuggagagccggug

SEQ ID NO: 5687 - RNA, 21 nt, artificial sequence
  siRNA Sense Sequence
agccaacccggcugcguguau

SEQ ID NO: 5688 - RNA, 23 nt, artificial sequence
  siRNA Antisense Sequence
auacacgcagccggguuggcugu

SEQ ID NO: 5689 - RNA, 21 nt, artificial sequence
  siRNA Sense Sequence
cugcguguagagauggaggau

SEQ ID NO: 5690 - RNA, 23 nt, artificial sequence
  siRNA Antisense Sequence
auccuccaucucuacacgcagcc

SEQ ID NO: 5691 - RNA, 21 nt, artificial sequence
  siRNA Sense Sequence
gaggacugggagggcaaccuu

SEQ ID NO: 5692 - RNA, 23 nt, artificial sequence
  siRNA Antisense Sequence
aagguugcccucccaguccucca

SEQ ID NO: 5693 - RNA, 21 nt, artificial sequence
  siRNA Sense Sequence
ggcaaccugcgcuacgcugau

SEQ ID NO: 5694 - RNA, 23 nt, artificial sequence
  siRNA Antisense Sequence
aucagcguagcgcagguugcccu

SEQ ID NO: 5695 - RNA, 21 nt, artificial sequence
  siRNA Sense Sequence
uacgcugaguauagccacuuu

SEQ ID NO: 5696 - RNA, 23 nt, artificial sequence
  siRNA Antisense Sequence
aaaguggcuauacucagcguagc

SEQ ID NO: 5697 - RNA, 21 nt, artificial sequence
  siRNA Sense Sequence
uagccacuuuguuuugggcau

SEQ ID NO: 5698 - RNA, 23 nt, artificial sequence
  siRNA Antisense Sequence
augcccaaaacaaaguggcuaua

SEQ ID NO: 5699 - RNA, 21 nt, artificial sequence
  siRNA Sense Sequence
uuugggcaaugaacucaacau

SEQ ID NO: 5700 - RNA, 23 nt, artificial sequence
  siRNA Antisense Sequence
auguugaguucauugcccaaaac

SEQ ID NO: 5701 - RNA, 21 nt, artificial sequence
  siRNA Sense Sequence
aacagcuaucgccucuuccuu

SEQ ID NO: 5702 - RNA, 23 nt, artificial sequence
  siRNA Antisense Sequence
aaggaagaggcgauagcuguuga

SEQ ID NO: 5703 - RNA, 21 nt, artificial sequence
  siRNA Sense Sequence
gaacuacacuggcaauguggu

SEQ ID NO: 5704 - RNA, 23 nt, artificial sequence
  siRNA Antisense Sequence
accacauugccaguguaguuccc

SEQ ID NO: 5705 - RNA, 21 nt, artificial sequence
  siRNA Sense Sequence
ccuccaguaucauaacaacau

SEQ ID NO: 5706 - RNA, 23 nt, artificial sequence
  siRNA Antisense Sequence
auguuguuaugauacuggagggc

SEQ ID NO: 5707 - RNA, 21 nt, artificial sequence
  siRNA Sense Sequence
agccuucagcaccaaggacau

SEQ ID NO: 5708 - RNA, 23 nt, artificial sequence
  siRNA Antisense Sequence
auguccuuggugcugaaggcugu

SEQ ID NO: 5709 - RNA, 21 nt, artificial sequence
  siRNA Sense Sequence
aaggacaaggacaaugacaau

SEQ ID NO: 5710 - RNA, 23 nt, artificial sequence
  siRNA Antisense Sequence
auugucauuguccuuguccuugg

SEQ ID NO: 5711 - RNA, 21 nt, artificial sequence
  siRNA Sense Sequence
ugacaacugcuuggacaaguu

SEQ ID NO: 5712 - RNA, 23 nt, artificial sequence
  siRNA Antisense Sequence
aacuuguccaagcaguugucauu

SEQ ID NO: 5713 - RNA, 21 nt, artificial sequence
  siRNA Sense Sequence
uggacaagugugcacagcucu

SEQ ID NO: 5714 - RNA, 23 nt, artificial sequence
  siRNA Antisense Sequence
agagcugugcacacuuguccaag

SEQ ID NO: 5715 - RNA, 21 nt, artificial sequence
  siRNA Sense Sequence
gcuccgcaaagguggcuacuu

SEQ ID NO: 5716 - RNA, 23 nt, artificial sequence
  siRNA Antisense Sequence
aaguagccaccuuugcggagcug

SEQ ID NO: 5717 - RNA, 21 nt, artificial sequence
  siRNA Sense Sequence
uggcuacugguacaacugcuu

SEQ ID NO: 5718 - RNA, 23 nt, artificial sequence
  siRNA Antisense Sequence
aagcaguuguaccaguagccacc

SEQ ID NO: 5719 - RNA, 21 nt, artificial sequence
  siRNA Sense Sequence
gcacagacuccaaccucaauu

SEQ ID NO: 5720 - RNA, 23 nt, artificial sequence
  siRNA Antisense Sequence
aauugagguuggagucugugcag

SEQ ID NO: 5721 - RNA, 21 nt, artificial sequence
  siRNA Sense Sequence
aaccucaauggaguguacuau

SEQ ID NO: 5722 - RNA, 23 nt, artificial sequence
  siRNA Antisense Sequence
auaguacacuccauugagguugg

SEQ ID NO: 5723 - RNA, 21 nt, artificial sequence
  siRNA Sense Sequence
acuaccgccugggugagcacu

SEQ ID NO: 5724 - RNA, 23 nt, artificial sequence
  siRNA Antisense Sequence
agugcucacccaggcgguaguac

SEQ ID NO: 5725 - RNA, 21 nt, artificial sequence
  siRNA Sense Sequence
ggugagcacaauaagcaccuu

SEQ ID NO: 5726 - RNA, 23 nt, artificial sequence
  siRNA Antisense Sequence
aaggugcuuauugugcucaccca

SEQ ID NO: 5727 - RNA, 21 nt, artificial sequence
  siRNA Sense Sequence
uggauggcaucaccugguauu

SEQ ID NO: 5728 - RNA, 23 nt, artificial sequence
  siRNA Antisense Sequence
aauaccaggugaugccauccagg

SEQ ID NO: 5729 - RNA, 21 nt, artificial sequence
  siRNA Sense Sequence
accugguauggcuggcauggu

SEQ ID NO: 5730 - RNA, 23 nt, artificial sequence
  siRNA Antisense Sequence
accaugccagccauaccagguga

SEQ ID NO: 5731 - RNA, 21 nt, artificial sequence
  siRNA Sense Sequence
cuggcauggaucuaccuacuu

SEQ ID NO: 5732 - RNA, 23 nt, artificial sequence
  siRNA Antisense Sequence
aaguagguagauccaugccagcc

SEQ ID NO: 5733 - RNA, 21 nt, artificial sequence
  siRNA Sense Sequence
uaccuacucccucaaacgggu

SEQ ID NO: 5734 - RNA, 23 nt, artificial sequence
  siRNA Antisense Sequence
acccguuugagggaguagguaga

SEQ ID NO: 5735 - RNA, 21 nt, artificial sequence
  siRNA Sense Sequence
acggguggagaugaaaauccu

SEQ ID NO: 5736 - RNA, 23 nt, artificial sequence
  siRNA Antisense Sequence
aggauuuucaucuccacccguuu

SEQ ID NO: 5737 - RNA, 21 nt, artificial sequence
  siRNA Sense Sequence
cccagaagacuucaagccuuu

SEQ ID NO: 5738 - RNA, 23 nt, artificial sequence
  siRNA Antisense Sequence
aaaggcuugaagucuucugggcg

SEQ ID NO: 5739 - RNA, 21 nt, artificial sequence
  siRNA Sense Sequence
ucaagccuuaaaaggaggcuu

SEQ ID NO: 5740 - RNA, 23 nt, artificial sequence
  siRNA Antisense Sequence
aagccuccuuuuaaggcuugaag

SEQ ID NO: 5741 - RNA, 21 nt, artificial sequence
  siRNA Sense Sequence
agcacggauacagaaacugau

SEQ ID NO: 5742 - RNA, 23 nt, artificial sequence
  siRNA Antisense Sequence
aucaguuucuguauccgugcucc

SEQ ID NO: 5743 - RNA, 21 nt, artificial sequence
  siRNA Sense Sequence
gagacacguggagacuggauu

SEQ ID NO: 5744 - RNA, 23 nt, artificial sequence
  siRNA Antisense Sequence
aauccagucuccacgugucucag

SEQ ID NO: 5745 - RNA, 21 nt, artificial sequence
  siRNA Sense Sequence
agacuggaugagggcagaugu

SEQ ID NO: 5746 - RNA, 23 nt, artificial sequence
  siRNA Antisense Sequence
acaucugcccucauccagucucc

SEQ ID NO: 5747 - RNA, 21 nt, artificial sequence
  siRNA Sense Sequence
ggcagaugaggacaggaagau

SEQ ID NO: 5748 - RNA, 23 nt, artificial sequence
  siRNA Antisense Sequence
aucuuccuguccucaucugcccu

SEQ ID NO: 5749 - RNA, 21 nt, artificial sequence
  siRNA Sense Sequence
caggaagagaguguuagaaau

SEQ ID NO: 5750 - RNA, 23 nt, artificial sequence
  siRNA Antisense Sequence
auuucuaacacucucuuccuguc

SEQ ID NO: 5751 - RNA, 21 nt, artificial sequence
  siRNA Sense Sequence
gaaaggguaggacugagaaau

SEQ ID NO: 5752 - RNA, 23 nt, artificial sequence
  siRNA Antisense Sequence
auuucucaguccuacccuuucua

SEQ ID NO: 5753 - RNA, 21 nt, artificial sequence
  siRNA Sense Sequence
acugagaaacagccuauaauu

SEQ ID NO: 5754 - RNA, 23 nt, artificial sequence
  siRNA Antisense Sequence
aauuauaggcuguuucucagucc

SEQ ID NO: 5755 - RNA, 21 nt, artificial sequence
  siRNA Sense Sequence
ucuccaaagaaagaauaaguu

SEQ ID NO: 5756 - RNA, 23 nt, artificial sequence
  siRNA Antisense Sequence
aacuuauucuuucuuuggagauu

SEQ ID NO: 5757 - RNA, 21 nt, artificial sequence
  siRNA Sense Sequence
uaagucuccaaggagcacaau

SEQ ID NO: 5758 - RNA, 23 nt, artificial sequence
  siRNA Antisense Sequence
auugugcuccuuggagacuuauu

SEQ ID NO: 5759 - RNA, 21 nt, artificial sequence
  siRNA Sense Sequence
ucauauguaccaaggauguuu

SEQ ID NO: 5760 - RNA, 23 nt, artificial sequence
  siRNA Antisense Sequence
aaacauccuugguacauaugauu

SEQ ID NO: 5761 - RNA, 21 nt, artificial sequence
  siRNA Sense Sequence
aaggauguuacaguaaacagu

SEQ ID NO: 5762 - RNA, 23 nt, artificial sequence
  siRNA Antisense Sequence
acuguuuacuguaacauccuugg

SEQ ID NO: 5763 - RNA, 21 nt, artificial sequence
  siRNA Sense Sequence
acaggaugaacuauuuaaacu

SEQ ID NO: 5764 - RNA, 23 nt, artificial sequence
  siRNA Antisense Sequence
aguuuaaauaguucauccuguuu

SEQ ID NO: 5765 - RNA, 21 nt, artificial sequence
  siRNA Sense Sequence
auuuaaacccacuggguccuu

SEQ ID NO: 5766 - RNA, 23 nt, artificial sequence
  siRNA Antisense Sequence
aaggacccaguggguuuaaauag

SEQ ID NO: 5767 - RNA, 21 nt, artificial sequence
  siRNA Sense Sequence
ugccacauccuucucaagguu

SEQ ID NO: 5768 - RNA, 23 nt, artificial sequence
  siRNA Antisense Sequence
aaccuugagaaggauguggcagg

SEQ ID NO: 5769 - RNA, 21 nt, artificial sequence
  siRNA Sense Sequence
ucucaaggugguagacugagu

SEQ ID NO: 5770 - RNA, 23 nt, artificial sequence
  siRNA Antisense Sequence
acucagucuaccaccuugagaag

SEQ ID NO: 5771 - RNA, 21 nt, artificial sequence
  siRNA Sense Sequence
ucucucugcccaagaucccuu

SEQ ID NO: 5772 - RNA, 23 nt, artificial sequence
  siRNA Antisense Sequence
aagggaucuugggcagagagacc

SEQ ID NO: 5773 - RNA, 21 nt, artificial sequence
  siRNA Sense Sequence
ucccugacauagcaguagcuu

SEQ ID NO: 5774 - RNA, 23 nt, artificial sequence
  siRNA Antisense Sequence
aagcuacugcuaugucagggauc

SEQ ID NO: 5775 - RNA, 21 nt, artificial sequence
  siRNA Sense Sequence
gcaguagcuugucuuuuccau

SEQ ID NO: 5776 - RNA, 23 nt, artificial sequence
  siRNA Antisense Sequence
auggaaaagacaagcuacugcua

SEQ ID NO: 5777 - RNA, 21 nt, artificial sequence
  siRNA Sense Sequence
ucuuuuccacaugauuugucu

SEQ ID NO: 5778 - RNA, 23 nt, artificial sequence
  siRNA Antisense Sequence
agacaaaucauguggaaaagaca

SEQ ID NO: 5779 - RNA, 21 nt, artificial sequence
  siRNA Sense Sequence
auuugucugugaaagaaaauu

SEQ ID NO: 5780 - RNA, 23 nt, artificial sequence
  siRNA Antisense Sequence
aauuuucuuucacagacaaauca

SEQ ID NO: 5781 - RNA, 21 nt, artificial sequence
  siRNA Sense Sequence
agaucguuuuaucuauuuucu

SEQ ID NO: 5782 - RNA, 23 nt, artificial sequence
  siRNA Antisense Sequence
agaaaauagauaaaacgaucuca

SEQ ID NO: 5783 - RNA, 21 nt, artificial sequence
  siRNA Sense Sequence
ucuacggcuuaggcuaugugu

SEQ ID NO: 5784 - RNA, 23 nt, artificial sequence
  siRNA Antisense Sequence
acacauagccuaagccguagaga

SEQ ID NO: 5785 - RNA, 21 nt, artificial sequence
  siRNA Sense Sequence
gugagggcaaaacacaaaucu

SEQ ID NO: 5786 - RNA, 23 nt, artificial sequence
  siRNA Antisense Sequence
agauuuguguuuugcccucacau

SEQ ID NO: 5787 - RNA, 21 nt, artificial sequence
  siRNA Sense Sequence
acacaaaucccuuugcuaaau

SEQ ID NO: 5788 - RNA, 23 nt, artificial sequence
  siRNA Antisense Sequence
auuuagcaaagggauuuguguuu

SEQ ID NO: 5789 - RNA, 21 nt, artificial sequence
  siRNA Sense Sequence
accauauuauuuugauucucu

SEQ ID NO: 5790 - RNA, 23 nt, artificial sequence
  siRNA Antisense Sequence
agagaaucaaaauaauaugguuc

SEQ ID NO: 5791 - RNA, 21 nt, artificial sequence
  siRNA Sense Sequence
cucaaaggauaggccuuugau

SEQ ID NO: 5792 - RNA, 23 nt, artificial sequence
  siRNA Antisense Sequence
aucaaaggccuauccuuugagaa

SEQ ID NO: 5793 - RNA, 21 nt, artificial sequence
  siRNA Sense Sequence
gccuuugaguguuagagaaau

SEQ ID NO: 5794 - RNA, 23 nt, artificial sequence
  siRNA Antisense Sequence
auuucucuaacacucaaaggccu

SEQ ID NO: 5795 - RNA, 21 nt, artificial sequence
  siRNA Sense Sequence
gagaaaggagugaaggaggcu

SEQ ID NO: 5796 - RNA, 23 nt, artificial sequence
  siRNA Antisense Sequence
agccuccuucacuccuuucucua

SEQ ID NO: 5797 - RNA, 21 nt, artificial sequence
  siRNA Sense Sequence
aggugggaaaugguauuucuu

SEQ ID NO: 5798 - RNA, 23 nt, artificial sequence
  siRNA Antisense Sequence
aagaaauaccauuucccaccugc

SEQ ID NO: 5799 - RNA, 21 nt, artificial sequence
  siRNA Sense Sequence
cagugaaauuaucuugagucu

SEQ ID NO: 5800 - RNA, 23 nt, artificial sequence
  siRNA Antisense Sequence
agacucaagauaauuucacugga

SEQ ID NO: 5801 - RNA, 21 nt, artificial sequence
  siRNA Sense Sequence
uugagucuacacauuauuuuu

SEQ ID NO: 5802 - RNA, 23 nt, artificial sequence
  siRNA Antisense Sequence
aaaaauaauguguagacucaaga

SEQ ID NO: 5803 - RNA, 21 nt, artificial sequence
  siRNA Sense Sequence
aauuguucggcuggaacugau

SEQ ID NO: 5804 - RNA, 23 nt, artificial sequence
  siRNA Antisense Sequence
aucaguuccagccgaacaauuuu

SEQ ID NO: 5805 - RNA, 21 nt, artificial sequence
  siRNA Sense Sequence
ugacccaggcuggacuugcgu

SEQ ID NO: 5806 - RNA, 23 nt, artificial sequence
  siRNA Antisense Sequence
acgcaaguccagccugggucagu

SEQ ID NO: 5807 - RNA, 21 nt, artificial sequence
  siRNA Sense Sequence
gaggaaacuccagggcacugu

SEQ ID NO: 5808 - RNA, 23 nt, artificial sequence
  siRNA Antisense Sequence
acagugcccuggaguuuccuccc

SEQ ID NO: 5809 - RNA, 21 nt, artificial sequence
  siRNA Sense Sequence
gcacugcaucuggcgaucagu

SEQ ID NO: 5810 - RNA, 23 nt, artificial sequence
  siRNA Antisense Sequence
acugaucgccagaugcagugccc

SEQ ID NO: 5811 - RNA, 21 nt, artificial sequence
  siRNA Sense Sequence
gcgaucagacucugagcacuu

SEQ ID NO: 5812 - RNA, 23 nt, artificial sequence
  siRNA Antisense Sequence
aagugcucagagucugaucgcca

SEQ ID NO: 5813 - RNA, 21 nt, artificial sequence
  siRNA Sense Sequence
cgccuuggucauguacagcau

SEQ ID NO: 5814 - RNA, 23 nt, artificial sequence
  siRNA Antisense Sequence
augcuguacaugaccaaggcgag

SEQ ID NO: 5815 - RNA, 21 nt, artificial sequence
  siRNA Sense Sequence
cagcacugaaaggaaugaagu

SEQ ID NO: 5816 - RNA, 23 nt, artificial sequence
  siRNA Antisense Sequence
acuucauuccuuucagugcugua

SEQ ID NO: 5817 - RNA, 21 nt, artificial sequence
  siRNA Sense Sequence
ggaaugaagcaccagcaggau

SEQ ID NO: 5818 - RNA, 23 nt, artificial sequence
  siRNA Antisense Sequence
auccugcuggugcuucauuccuu

SEQ ID NO: 5819 - RNA, 21 nt, artificial sequence
  siRNA Sense Sequence
cagcaggagguggacagaguu

SEQ ID NO: 5820 - RNA, 23 nt, artificial sequence
  siRNA Antisense Sequence
aacucuguccaccuccugcuggu

SEQ ID NO: 5821 - RNA, 21 nt, artificial sequence
  siRNA Sense Sequence
ggacagagucucucauggauu

SEQ ID NO: 5822 - RNA, 23 nt, artificial sequence
  siRNA Antisense Sequence
aauccaugagagacucuguccac

SEQ ID NO: 5823 - RNA, 21 nt, artificial sequence
  siRNA Sense Sequence
cucauggaugccggcacaaau

SEQ ID NO: 5824 - RNA, 23 nt, artificial sequence
  siRNA Antisense Sequence
auuugugccggcauccaugagag

SEQ ID NO: 5825 - RNA, 21 nt, artificial sequence
  siRNA Sense Sequence
gcacaaaacugccuuaaaauu

SEQ ID NO: 5826 - RNA, 23 nt, artificial sequence
  siRNA Antisense Sequence
aauuuuaaggcaguuuugugccg

SEQ ID NO: 5827 - RNA, 21 nt, artificial sequence
  siRNA Sense Sequence
uaguuaauacagguauaucuu

SEQ ID NO: 5828 - RNA, 23 nt, artificial sequence
  siRNA Antisense Sequence
aagauauaccuguauuaacuaug

SEQ ID NO: 5829 - RNA, 21 nt, artificial sequence
  siRNA Sense Sequence
cuuuguaagaaacaagcucau

SEQ ID NO: 5830 - RNA, 23 nt, artificial sequence
  siRNA Antisense Sequence
augagcuuguuucuuacaaagua

SEQ ID NO: 5831 - RNA, 21 nt, artificial sequence
  siRNA Sense Sequence
ggagcuuccuuuuaaauuuuu

SEQ ID NO: 5832 - RNA, 23 nt, artificial sequence
  siRNA Antisense Sequence
aaaaauuuaaaaggaagcuccuu

SEQ ID NO: 5833 - RNA, 21 nt, artificial sequence
  siRNA Sense Sequence
cuguaggaaaugguugaaaau

SEQ ID NO: 5834 - RNA, 23 nt, artificial sequence
  siRNA Antisense Sequence
auuuucaaccauuuccuacagac

SEQ ID NO: 5835 - RNA, 21 nt, artificial sequence
  siRNA Sense Sequence
guugaaaacugaagguagauu

SEQ ID NO: 5836 - RNA, 23 nt, artificial sequence
  siRNA Antisense Sequence
aaucuaccuucaguuuucaacca

SEQ ID NO: 5837 - RNA, 21 nt, artificial sequence
  siRNA Sense Sequence
aagguagaugguguuauaguu

SEQ ID NO: 5838 - RNA, 23 nt, artificial sequence
  siRNA Antisense Sequence
aacuauaacaccaucuaccuuca

SEQ ID NO: 5839 - RNA, 21 nt, artificial sequence
  siRNA Sense Sequence
guaaauaagcaucucacuuuu

SEQ ID NO: 5840 - RNA, 23 nt, artificial sequence
  siRNA Antisense Sequence
aaaagugagaugcuuauuuacag

SEQ ID NO: 5841 - RNA, 21 nt, artificial sequence
  siRNA Sense Sequence
ugguuuuguuuuaaacauucu

SEQ ID NO: 5842 - RNA, 23 nt, artificial sequence
  siRNA Antisense Sequence
agaauguuuaaaacaaaaccaca

SEQ ID NO: 5843 - RNA, 21 nt, artificial sequence
  siRNA Sense Sequence
aacauucaacguuucuuuucu

SEQ ID NO: 5844 - RNA, 23 nt, artificial sequence
  siRNA Antisense Sequence
agaaaagaaacguugaauguuua

SEQ ID NO: 5845 - RNA, 21 nt, artificial sequence
  siRNA Sense Sequence
cuuuuccuucuacaauaaacu

SEQ ID NO: 5846 - RNA, 23 nt, artificial sequence
  siRNA Antisense Sequence
aguuuauuguagaaggaaaagaa

What is claimed is:

1. A method of treating a subject having rheumatoid arthritis, Graves' disease, or ophthalmic inflammation, the method comprising administering an Angiopoietin-Like 7 (ANGPTL7) inhibitor and a glucocorticoid to the subject, wherein:
   the ANGPTL7 inhibitor is a double stranded ribonucleic acid (dsRNA) inhibitory nucleic acid molecule for inhibiting expression of ANGPTL7; and
   the dsRNA inhibitory nucleic acid molecule comprises a sense strand and an antisense strand forming a double stranded region; and
   the sense strand comprises a nucleotide sequence comprising AGACAGUAUAAGCAAGGGUUA (SEQ ID NO:5555) and wherein the antisense strand comprises a nucleotide sequence comprising UAACCCUUGCUUAUACUGUCUCC (SEQ ID NO:5556); and/or
   the sense strand comprises a nucleotide sequence comprising ACACUUCCUUGUGUCUAUAGA (SEQ ID NO:5533) and wherein the antisense strand comprises a nucleotide sequence comprising UCUAUAGACACAAGGAAGUGUCG (SEQ ID NO:5534).

2. A method of decreasing a glucocorticoid-induced ophthalmic condition in a subject treated with a glucocorticoid, the method comprising administering an Angiopoietin-Like 7 (ANGPTL7) inhibitor to the subject, wherein:
   the ANGPTL7 inhibitor is a double stranded ribonucleic acid (dsRNA) inhibitory nucleic acid molecule for inhibiting expression of ANGPTL7; and
   the dsRNA inhibitory nucleic acid molecule comprises a sense strand and an antisense strand forming a double stranded region; and
   the sense strand comprises a nucleotide sequence comprising AGACAGUAUAAGCAAGGGUUA (SEQ ID NO:5555) and wherein the antisense strand comprises a nucleotide sequence comprising UAACCCUUGCUUAUACUGUCUCC (SEQ ID NO:5556); and/or
   the sense strand comprises a nucleotide sequence comprising ACACUUCCUUGUGUCUAUAGA (SEQ ID NO:5533) and wherein the antisense strand comprises a nucleotide sequence comprising UCUAUAGACACAAGGAAGUGUCG (SEQ ID NO:5534).

3. A method of treating a subject having inflammation, rheumatoid arthritis, Graves' disease, or ophthalmic inflammation, and undergoing glucocorticoid treatment, the method comprising administering an Angiopoietin-Like 7 (ANGPTL7) inhibitor to the subject, wherein:
   the ANGPTL7 inhibitor is a double stranded ribonucleic acid (dsRNA) inhibitory nucleic acid molecule for inhibiting expression of ANGPTL7; and
   the dsRNA inhibitory nucleic acid molecule comprises a sense strand and an antisense strand forming a double stranded region; and
   the sense strand comprises a nucleotide sequence comprising AGACAGUAUAAGCAAGGGUUA (SEQ ID NO:5555) and wherein the antisense strand comprises a nucleotide sequence comprising UAACCCUUGCUUAUACUGUCUCC (SEQ ID NO:5556); and/or
   the sense strand comprises a nucleotide sequence comprising ACACUUCCUUGUGUCUAUAGA (SEQ ID NO:5533) and wherein the antisense strand comprises a nucleotide sequence comprising UCUAUAGACACAAGGAAGUGUCG (SEQ ID NO:5534).

\* \* \* \* \*